US011370832B2

(12) United States Patent
Chen et al.

(10) Patent No.: US 11,370,832 B2
(45) Date of Patent: Jun. 28, 2022

(54) ANTI-TAU ANTIBODIES AND METHODS OF USE THEREOF

(71) Applicant: Denali Therapeutics Inc., South San Francisco, CA (US)

(72) Inventors: Xiaocheng Chen, South San Francisco, CA (US); Mark S. Dennis, South San Francisco, CA (US); Lesley Ann Kane, South San Francisco, CA (US); Do Jin Kim, South San Francisco, CA (US); Joseph W. Lewcock, South San Francisco, CA (US); Suresh Poda, South San Francisco, CA (US); Rishi Rakhit, South San Francisco, CA (US); Rinkan Shukla, South San Francisco, CA (US); Adam P. Silverman, South San Francisco, CA (US)

(73) Assignee: Denali Therapeutics Inc., South San Francisco, CA (US)

( * ) Notice: Subject to any disclaimer, the term of this patent is extended or adjusted under 35 U.S.C. 154(b) by 0 days.

(21) Appl. No.: 16/543,367

(22) Filed: Aug. 16, 2019

(65) Prior Publication Data
US 2020/0216522 A1 Jul. 9, 2020

Related U.S. Application Data

(63) Continuation of application No. PCT/US2018/018415, filed on Feb. 15, 2018.

(60) Provisional application No. 62/583,400, filed on Nov. 8, 2017, provisional application No. 62/460,642, filed on Feb. 17, 2017.

(51) Int. Cl.
*C07K 16/18* (2006.01)
*A61P 25/28* (2006.01)
*A61K 39/00* (2006.01)

(52) U.S. Cl.
CPC ............ *C07K 16/18* (2013.01); *A61P 25/28* (2018.01); *A61K 2039/505* (2013.01); *C07K 2317/21* (2013.01); *C07K 2317/24* (2013.01); *C07K 2317/31* (2013.01); *C07K 2317/33* (2013.01); *C07K 2317/34* (2013.01); *C07K 2317/35* (2013.01); *C07K 2317/54* (2013.01); *C07K 2317/55* (2013.01); *C07K 2317/565* (2013.01); *C07K 2317/622* (2013.01)

(58) Field of Classification Search
CPC ........................ C07K 16/18; C07K 2317/21; C07K 2317/24; C07K 2317/31; C07K 2317/33; C07K 2317/34; C07K 2317/35; C07K 2317/54; C07K 2317/55; C07K 2317/565; C07K 2317/622; A61K 2039/505; A61K 39/3955

See application file for complete search history.

(56) References Cited

U.S. PATENT DOCUMENTS

| | | | |
|---|---|---|---|
| 7,435,804 B2 * | 10/2008 | Kordyum ............ | C07K 16/005 435/252.33 |
| 7,442,516 B2 | 10/2008 | Ohno et al. | |
| 7,582,736 B2 | 9/2009 | Liu et al. | |
| 8,703,137 B2 | 4/2014 | Chain | |
| 8,748,386 B2 | 6/2014 | Sigurdsson | |
| 8,778,343 B2 | 7/2014 | Kayed | |
| 8,926,974 B2 | 1/2015 | Griswold-Prenner et al. | |
| 8,980,270 B2 | 3/2015 | Griswold-Prenner et al. | |
| 8,980,271 B2 | 3/2015 | Griswold-Prenner et al. | |
| 9,051,367 B2 | 6/2015 | Griswold-Prenner et al. | |
| 9,272,030 B2 | 3/2016 | Black et al. | |
| 9,304,138 B2 | 4/2016 | Pfeifer et al. | |
| 9,447,179 B2 | 9/2016 | Winderickx et al. | |
| 9,447,180 B2 | 9/2016 | Griswold-Prenner et al. | |
| 9,518,101 B2 | 12/2016 | Novak et al. | |
| 9,527,909 B2 | 12/2016 | Hayashi et al. | |
| 9,540,434 B2 | 1/2017 | Pfeifer et al. | |
| 9,562,091 B2 | 2/2017 | Grueninger et al. | |
| 9,567,395 B2 | 2/2017 | Griswold-Prenner et al. | |
| 9,598,484 B2 | 3/2017 | Weinreb et al. | |
| 9,598,485 B2 | 3/2017 | Ayalon et al. | |
| 9,605,042 B2 | 3/2017 | Ashe et al. | |
| 9,605,059 B2 | 3/2017 | Nitsch et al. | |

(Continued)

FOREIGN PATENT DOCUMENTS

| | | | |
|---|---|---|---|
| EP | 2627672 A1 | 8/2013 | |
| EP | 3239175 A1 | 11/2017 | |

(Continued)

OTHER PUBLICATIONS

Padlan et al. Proc Natl Acad Sci USA, 1989; 86:5938-5942. (Year: 1989).*

(Continued)

*Primary Examiner* — Kimberly Ballard
(74) *Attorney, Agent, or Firm* — Kilpatrick Townsend & Stockton LLP

(57) ABSTRACT

In one aspect, antibodies that specifically bind to a human Tau protein are provided. In some embodiments, an anti-Tau antibody recognizes an epitope within residues 111-125 of full-length human Tau, an epitope within residues 251-270 and/or residues 346-360 of full-length human Tau, or an epitope within residues 186-205 of full-length human Tau. In some embodiments, an anti-Tau antibody specifically binds to phosphorylated human Tau, unphosphorylated human Tau, and/or multiple splice isoforms of human Tau. An anti-Tau antibody disclosed herein may also include one or two modified Fc polypeptides.

26 Claims, 44 Drawing Sheets

Specification includes a Sequence Listing.

(56) References Cited

U.S. PATENT DOCUMENTS

| | | |
|---|---|---|
| 9,650,436 B2 | 5/2017 | Sierks et al. |
| 9,657,091 B2 | 5/2017 | Pfeifer et al. |
| 9,688,747 B2 | 6/2017 | Lu et al. |
| 9,733,260 B2 | 8/2017 | Michaelsen et al. |
| 9,777,056 B2 | 10/2017 | Sigurdsson et al. |
| 9,828,421 B2 | 11/2017 | Novák et al. |
| 9,834,596 B2 | 12/2017 | Holtzman et al. |
| 9,862,761 B2 | 1/2018 | Brady et al. |
| 9,862,763 B2 | 1/2018 | Dengl et al. |
| 9,914,781 B1* | 3/2018 | Bhinder .......... C07K 16/2863 |
| 9,957,317 B2 | 5/2018 | West et al. |
| 9,993,564 B2 | 6/2018 | Freskgard et al. |
| 10,000,559 B2 | 6/2018 | Alderfer et al. |
| 10,011,653 B2 | 7/2018 | Hayashi et al. |
| 10,040,847 B2 | 8/2018 | Griswold-Prenner et al. |
| 10,066,010 B2 | 9/2018 | Pfeifer et al. |
| 10,087,245 B2 | 10/2018 | Lafaye et al. |
| 10,098,973 B2 | 10/2018 | Sutherland et al. |
| 10,100,104 B2 | 10/2018 | Pfeifer et al. |
| 10,112,990 B2 | 10/2018 | Adolfsson et al. |
| 10,132,818 B2 | 11/2018 | Sigurdsson |
| 10,160,799 B2 | 12/2018 | Novak et al. |
| 10,196,439 B2 | 2/2019 | Pedersen et al. |
| 10,196,440 B2 | 2/2019 | Alderfer et al. |
| 10,202,444 B2 | 2/2019 | Florence et al. |
| 10,251,952 B2 | 4/2019 | Bader et al. |
| 10,266,585 B2 | 4/2019 | Kayed |
| 2008/0050383 A1 | 2/2008 | Sigurdsson et al. |
| 2012/0087861 A1 | 4/2012 | Nitsch et al. |
| 2015/0183854 A1 | 7/2015 | Mori et al. |
| 2015/0183855 A1* | 7/2015 | Diamond .......... A61P 25/00 424/139.1 |
| 2015/0368328 A1 | 12/2015 | Sigurdsson et al. |
| 2016/0024193 A1 | 1/2016 | Ayalon et al. |
| 2016/0031976 A1 | 2/2016 | Seubert et al. |
| 2016/0102138 A1 | 4/2016 | Iqbal et al. |
| 2016/0122422 A1 | 5/2016 | Chain |
| 2016/0289309 A1 | 10/2016 | Griswold-Prenner et al. |
| 2016/0304590 A1 | 10/2016 | Pfeifer et al. |
| 2016/0333063 A1 | 11/2016 | Hyman et al. |
| 2016/0347804 A1 | 12/2016 | Griswold-Prenner et al. |
| 2016/0356794 A1 | 12/2016 | Laterza et al. |
| 2017/0058022 A1 | 3/2017 | Lafaye et al. |
| 2017/0129949 A1 | 5/2017 | Grueninger et al. |
| 2017/0138400 A1 | 5/2017 | Pierce |
| 2017/0145082 A1 | 5/2017 | Novák et al. |
| 2017/0152307 A1 | 6/2017 | Wadia et al. |
| 2017/0198273 A1 | 7/2017 | Moe et al. |
| 2017/0210791 A1 | 7/2017 | Moe et al. |
| 2017/0253649 A1 | 9/2017 | Chain |
| 2017/0315136 A9 | 11/2017 | Wang et al. |
| 2017/0369560 A1 | 12/2017 | Weinreb et al. |
| 2018/0002409 A1 | 1/2018 | Nitsch et al. |
| 2018/0002414 A1 | 1/2018 | Sigurdsson et al. |
| 2018/0016330 A1 | 1/2018 | Pedersen et al. |
| 2018/0142007 A1* | 5/2018 | Novak .......... C07K 16/18 |
| 2018/0265577 A1 | 9/2018 | Hayashi et al. |
| 2018/0298086 A1 | 10/2018 | Sierks et al. |
| 2019/0010238 A1 | 1/2019 | Wisniewski et al. |

FOREIGN PATENT DOCUMENTS

| | | |
|---|---|---|
| EP | 3321286 A1 | 5/2018 |
| EP | 3160999 B1 | 11/2018 |
| WO | 9308302 A1 | 4/1993 |
| WO | 2005113798 A2 | 12/2005 |
| WO | 2007109747 A2 | 9/2007 |
| WO | 2010136508 A2 | 12/2010 |
| WO | 2010142423 A2 | 12/2010 |
| WO | 2011032155 A2 | 3/2011 |
| WO | 2010144711 A2 | 5/2011 |
| WO | 2012106363 A2 | 11/2012 |
| WO | 2015033223 A2 | 10/2015 |
| WO | 2015197820 A1 | 12/2015 |
| WO | 2016007414 A1 | 1/2016 |
| WO | 2016055941 A1 | 4/2016 |
| WO | 2016112078 A2 | 7/2016 |
| WO | 2016126993 A1 | 8/2016 |
| WO | 2016137950 A1 | 9/2016 |
| WO | 2016041553 A2 | 12/2016 |
| WO | 2016207245 A1 | 12/2016 |
| WO | 2016210434 A1 | 12/2016 |
| WO | 2017005732 A1 | 1/2017 |
| WO | 2017005734 A1 | 1/2017 |
| WO | 2017009308 A2 | 1/2017 |
| WO | 2017011556 A1 | 1/2017 |
| WO | 2017027685 A2 | 2/2017 |
| WO | 2017027691 A1 | 2/2017 |
| WO | 2016196726 A1 | 4/2017 |
| WO | 2017062672 A2 | 4/2017 |
| WO | 2017100632 A1 | 6/2017 |
| WO | 2017191559 A1 | 11/2017 |
| WO | 2017191560 A1 | 11/2017 |
| WO | 2017191561 A1 | 11/2017 |
| WO | 2017194589 A1 | 11/2017 |
| WO | 2018011073 A1 | 1/2018 |
| WO | 2018017370 A1 | 1/2018 |
| WO | 2018018031 A1 | 1/2018 |
| WO | 2018049219 A1 | 3/2018 |
| WO | 2018078140 A1 | 5/2018 |
| WO | 2018085653 A1 | 5/2018 |
| WO | 2018106776 A2 | 6/2018 |
| WO | 2018106781 A1 | 6/2018 |
| WO | 2018031361 A2 | 7/2018 |
| WO | 2018127519 A1 | 7/2018 |
| WO | 2018154390 A1 | 8/2018 |
| WO | 2018154392 A1 | 8/2018 |
| WO | 2018170351 A1 | 9/2018 |
| WO | 2018178077 A1 | 10/2018 |
| WO | 2018178078 A1 | 10/2018 |
| WO | 2018178080 A1 | 10/2018 |
| WO | 2018183175 A1 | 10/2018 |
| WO | 2018204546 A2 | 12/2018 |
| WO | 2018231254 A1 | 12/2018 |
| WO | 2019014429 A1 | 1/2019 |
| WO | 2019077500 A1 | 4/2019 |
| WO | 2019094576 A1 | 5/2019 |
| WO | 2019028191 A1 | 1/2020 |
| WO | 2016079597 A1 | 7/2020 |

OTHER PUBLICATIONS

Paul, Fundamental Immunology, Third Edition, 1993, pp. 292-295, under the heading "Fv Structure and Diversity in Three Dimensions". (Year: 1993).*

Rudikoff et al. Proc Natl Acad Sci USA, 1982; 79(6):1979-1983. (Year: 1982).*

International Search Report and Written Opinion for PCT/US2018/018415, International Filing Date: Feb. 15, 2018, pp. 1-10.

Saxena et al., "Advances in Therapeutic Ec Engineering-Modulation of IgG-Associated Effector Functions and Serum Half-life," Frontiers in Immunology, Dec. 12, 2016, vol. 7, pp. 1-11.

Zempel et al., "Lost after translation: missorting of Tau protein and consequences for Alzheimer disease," Trends in Neurosciences, Dec. 2014, 37(12), pp. 721-732.

Zempel et al., A beta Oligomers Cause Localized Ca2+ Elevation, Missorting of Endogenous Tau into Dendrites, Tau Phosphorylation, and Destruction of Microtubules and Spines, The Journal of Neuroscience, Sep. 8, 2010, 30(36), pp. 11938-11950.

* cited by examiner

FIG. 2A

```
                                His6-Smt3-Tau-441
         10         20         30         40         50         60         70         80         90        100
MGHHHHHHSG EVKPEVKPET HINLKVSDGS SEIFFKIKKT TPLRRLMEAF AKRQCKEMDS LRFLYDGIRI QADQTPEDLD MEDNDIIEAH REQIGG/SMAE
        110        120        130        140        150        160        170        180        190        200
PRQEFEVMED HAGTYGLGDR KDQGGYTMHQ DQEGDTDAGL KESPLQTPTE DGSEEPGSET SDAKSTPTAE DVTAPLVDEG APCKQAAAQP NTEIPEGTTA
        210        220        230        240        250        260        270        280        290        300
EEAGIGDTPS LEDEAAGHVT QARMVSKSKD GTGSDDKKAK QANATRIPA KTPPAPKTPP SSGEPPKSGD RSGYSSPGSP
        310        320        330        340        350        360        370        380        390        400
GTPGSRSRTP SLPTPPTREP KKVAVVRTPP KSPSSAKSRL QTAPVPMPDL KNVKSKICST ENLKHQPGGG KVQIINKKLD LSNVQSKCGS KDNIKHVPGG
        410        420        430        440        450        460        470        480        490        500
GSVQIVYKPV DLSKVTSKCG SLGNIHHKPG GGQVEVKSEK LDFKDRVQSK IGSLDNITHV PGGGNKKIET HKLTFRENAK AKTDHGAEIV YKSPVVSGDT
        510        520        530
SPRHLSNVSS TGSIDMVDSP QLATLADEVS ASLAKQGL (SEQ ID NO:3)
```

Original and cleaved product

Final r-tau antigen

1C7 – Residues 111-125 hTau 2N4R sequence        (SEQ ID NO:1)

MAEPRQEFEV MEDHAGTYGL GDRKDQGGYT MHQDQEGDTD
AGLKESPLQT PTEDGSEEPG SETSDAKSTP TAEDVTAPLV
DEGAPGKQAA AQPHTEIPEG TTAEEAGIGD TPSLEDEAAG
HVTQARMVSK SKDGTGSDDK KAKGADGKTK IATPRGAAPP
GQKGQANATR IPAKTPPAPK TPPSSGEPPK SGDRSGYSSP
GSPGTPGSRS RTPSLPTPPT REPKKVAVVR TPPKSPSSAK
SRLQTAPVPM PDLKNVKSKI GSTENLKHQP GGGKVQIINK
KLDLSNVQSK CGSKDNIKHV PGGGSVQIVY KPVDLSKVTS
KCGSLGNIHH KPGGGQVEVK SEKLDFKDRV QSKIGSLDNI
THVPGGGNKK IETHKLTFRE NAKAKTDHGA EIVYKSPVVS
GDTSPRHLSN VSSTGSIDMV DSPQLATLAD EVSASLAKQG
L

FIG. 10B

1A1 – Residues 251-270 (strongest 256-270) and residues 346-360 hTau 2N4R sequence        (SEQ ID NO:1)

MAEPRQEFEV MEDHAGTYGL GDRKDQGGYT MHQDQEGDTD
AGLKESPLQT PTEDGSEEPG SETSDAKSTP TAEDVTAPLV
DEGAPGKQAA AQPHTEIPEG TTAEEAGIGD TPSLEDEAAG
HVTQARMVSK SKDGTGSDDK KAKGADGKTK IATPRGAAPP
GQKGQANATR IPAKTPPAPK TPPSSGEPPK SGDRSGYSSP
GSPGTPGSRS RTPSLPTPPT REPKKVAVVR TPPKSPSSAK
SRLQTAPVPM PDLKNVKSKI GSTENLKHQP GGGKVQIINK
KLDLSNVQSK CGSKDNIKHV PGGGSVQIVY KPVDLSKVTS
KCGSLGNIHH KPGGGQVEVK SEKLDFKDRV QSKIGSLDNI
THVPGGGNKK IETHKLTFRE NAKAKTDHGA EIVYKSPVVS
GDTSPRHLSN VSSTGSIDMV DSPQLATLAD EVSASLAKQG
L

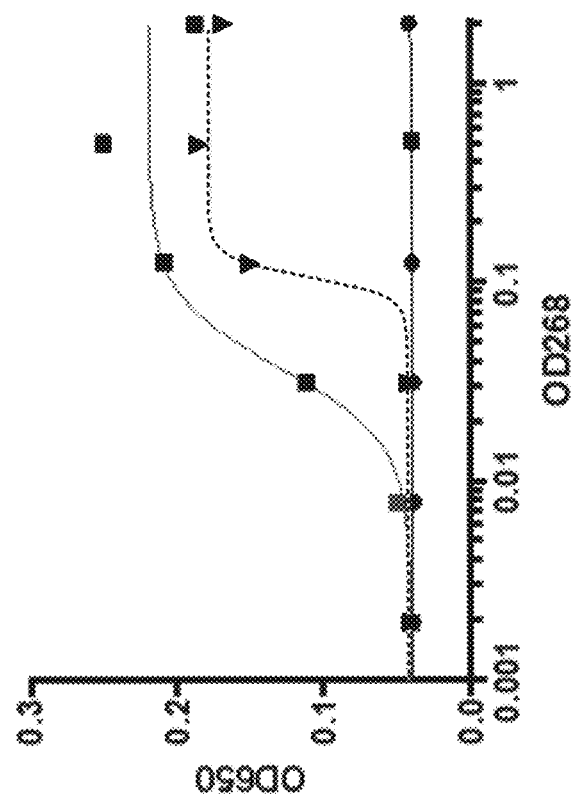
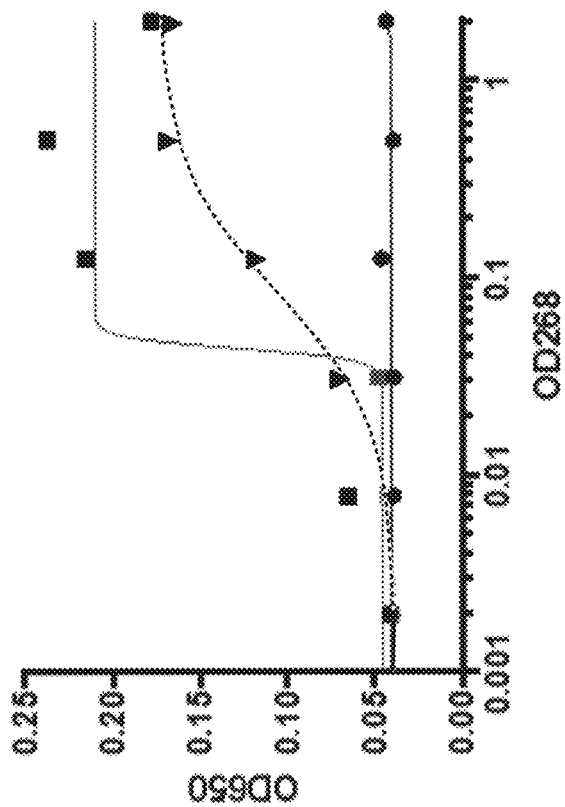
FIG. 14B

| Antibody | Isotype | Dose (mg/kg) | Age | Plasma Time points | n/group |
|---|---|---|---|---|---|
| Neg ctrl | hIgG1 | 35 | 3.5m | 0, 2d, 4d, 7d | 6 |
| Anti-Tau$^{Ab306}$ | hIgG1 | 35 | 3.5m | 0, 2d, 4d, 7d | 5 |
| Anti-Tau$^{Ab017}$ | hIgG1 | 35 | 3.5m | 0, 2d, 4d, 7d | 6 |
| Anti-Tau$^{1A1}$ | hIgG1 | 35 | 3.5m | 0, 2d, 4d, 7d | 6 |
| Anti-Tau$^{1C7}$ | hIgG1 | 35 | 3.5m | 0, 2d, 4d, 7d | 4 |

Plasma Total Tau Levels

Plasma Bound Tau Levels

| Antibody | Isotype | Dose (mg/kg) | Age | Plasma Time points | n/group |
|---|---|---|---|---|---|
| Neg ctrl | hIgG1 | 50 | 3.5m | 0, 2d | 6 |
| Anti-Tau$^{Ab017}$ | hIgG1 | 50 | 3.5m | 0, 2d | 5 |
| Anti-Tau$^{1C7}$ | hIgG1 | 50 | 3.5m | 0, 2d | 6 |

FIG. 26B

| Antibody | CL (mL/day/kg) |
|---|---|
| Anti-RSV | 11.5 |
| Clone with LC of SEQ ID NO:604 and HC of SEQ ID NO:602 | 48.8 |
| Clone with LC of SEQ ID NO:616 and HC of SEQ ID NO:602 | 49.9 |
| Clone with LC of SEQ ID NO:463 and HC of SEQ ID NO:602 | 17.4 |
| Clone with LC of SEQ ID NO:463 and HC of SEQ ID NO:603 | 17.8 |
| ch17G2.A1 | 8.3 |

ANTI-TAU ANTIBODIES AND METHODS OF USE THEREOF

CROSS-REFERENCE TO RELATED APPLICATIONS

The present application is a continuation of International Patent Application Serial No. PCT/US2018/018415, filed Feb. 15, 2018, which claims the benefit of and priority to U.S. Patent Application Ser. No. 62/460,642, filed Feb. 17, 2017, U.S. Patent Application Ser. No. 62/583,400, filed Nov. 8, 2017, the contents of which are incorporated herein by reference for all purposes.

SEQUENCE LISTING

The instant application contains a Sequence Listing which has been submitted electronically in ASCII format and is hereby incorporated by reference in its entirety. Said ASCII copy, created on Dec. 16, 2021, is named 102342-1150188-000220US_SL.txt and is 939,630 bytes in size.

BACKGROUND OF THE INVENTION

Tau protein aggregation and neurofibrillary tangles are common features in a number of neurodegenerative diseases, including Alzheimer's disease and frontotemporal dementia. Tau is highly expressed in neurons and functions in stabilizing microtubules and aiding the assembly of tubulin in microtubules. Phosphorylation of Tau protein is a primary mechanism by which Tau function is regulated. However, abnormal hyperphosphorylation of Tau can result in Tau aggregation. It is believed that after the initiation of Tau aggregation, the aggregates act as templates (or "seeds") for the misfolding of native Tau in the brain, resulting in the continued propagation of Tau aggregates and the formation of neurofibrillary tangles.

There remains a need for therapeutic agents that target Tau and that prevent Tau seeding and spreading.

BRIEF SUMMARY OF THE INVENTION

In one aspect, antibodies (or antigen-binding portions thereof) that specifically bind to a human Tau protein are provided. In some embodiments, the antibody recognizes an epitope within residues 111-125 of SEQ ID NO:1. In some embodiments, the antibody recognizes an epitope comprising at least 6 amino acids within residues 111-125 of SEQ ID NO:1. In some embodiments, the antibody recognizes an epitope comprising at least 6 contiguous amino acids within residues 111-125 of SEQ ID NO:1. In some embodiments, the antibody comprises one or more (e.g., one, two, three, four, five, or all six) complementarity determining regions (CDRs) selected from the group consisting of:
  (a) a heavy chain CDR1 having at least 90% sequence identity (90%, 92%, 94%, 96%, 98%, 99%, or 100% sequence identity) to the amino acid sequence of SEQ ID NO:22 or having up to two amino acid substitutions relative to the amino acid sequence of SEQ ID NO:22;
  (b) a heavy chain CDR2 having at least 90% sequence identity (90%, 92%, 94%, 96%, 98%, 99%, or 100% sequence identity) to the amino acid sequence of SEQ ID NO:23 or having up to two amino acid substitutions relative to the amino acid sequence of SEQ ID NO:23;
  (c) a heavy chain CDR3 having at least 90% sequence identity (90%, 92%, 94%, 96%, 98%, 99%, or 100% sequence identity) to the amino acid sequence of SEQ ID NO:24 or having up to two amino acid substitutions relative to the amino acid sequence of SEQ ID NO:24;
  (d) a light chain CDR1 having at least 90% sequence identity (90%, 92%, 94%, 96%, 98%, 99%, or 100% sequence identity) to the amino acid sequence of any one of SEQ ID NOS:26 and 42 or having up to two amino acid substitutions relative to the amino acid sequence of any one of SEQ ID NOS:26 and 42;
  (e) a light chain CDR2 having at least 90% sequence identity (90%, 92%, 94%, 96%, 98%, 99%, or 100% sequence identity) to the amino acid sequence of any one of SEQ ID NOS:27, 43, and 50 or having up to two amino acid substitutions relative to the amino acid sequence of any one of SEQ ID NOS:27, 43, and 50; and
  (f) a light chain CDR3 having at least 90% sequence identity (90%, 92%, 94%, 96%, 98%, 99%, or 100% sequence identity) to the amino acid sequence of any one of SEQ ID NOS:28, 44, 46, and 51 or having up to two amino acid substitutions relative to the amino acid sequence of any one of SEQ ID NOS:28, 44, 46, and 51.

In some embodiments, the antibody comprises one or more (e.g., one, two, three, four, five, or all six) CDRs selected from the group consisting of:
  (a) a heavy chain CDR1 comprising the amino acid sequence of SEQ ID NO:22;
  (b) a heavy chain CDR2 comprising the amino acid sequence of SEQ ID NO:23;
  (c) a heavy chain CDR3 comprising the amino acid sequence of SEQ ID NO:24;
  (d) a light chain CDR1 comprising the amino acid sequence of any one of SEQ ID NOS:26 and 42;
  (e) a light chain CDR2 comprising the amino acid sequence of any one of SEQ ID NOS:27, 43, and 50; and
  (f) a light chain CDR3 comprising the amino acid sequence of any one of SEQ ID NOS:28, 44, 46, and 51.

In some embodiments, the antibody comprises a heavy chain CDR1 comprising the amino acid sequence of SEQ ID NO:22, a heavy chain CDR2 comprising the amino acid sequence of SEQ ID NO:23, and a heavy chain CDR3 comprising the amino acid sequence of SEQ ID NO:24. In some embodiments, the antibody comprises a light chain CDR1 comprising the amino acid sequence of SEQ ID NO:26, a light chain CDR2 comprising the amino acid sequence of SEQ ID NO:27, and a light chain CDR3 comprising the amino acid sequence of SEQ ID NO:28. In some embodiments, the antibody comprises a heavy chain CDR1 comprising the amino acid sequence of SEQ ID NO:22, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:26, a light chain CDR2 comprising the amino acid sequence of SEQ ID NO:27, and a light chain CDR3 comprising the amino acid sequence of SEQ ID NO:28.

In some embodiments, the antibody comprises a heavy chain CDR1 comprising the amino acid sequence of SEQ ID NO:22, a heavy chain CDR2 comprising the amino acid sequence of SEQ ID NO:23, and a heavy chain CDR3 comprising the amino acid sequence of SEQ ID NO:24. In some embodiments, the antibody comprises a light chain CDR1 comprising the amino acid sequence of SEQ ID NO:42, a light chain CDR2 comprising the amino acid sequence of SEQ ID NO:43, and a light chain CDR3 comprising the amino acid sequence of SEQ ID NO:44. In some embodiments, the antibody comprises a heavy chain CDR1 comprising the amino acid sequence of SEQ ID NO:22, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:42, a light chain CDR2 comprising the amino acid sequence of SEQ ID NO:43, and a light chain CDR3 comprising the amino acid sequence of SEQ ID NO:44.

In some embodiments, the antibody comprises a heavy chain CDR1 comprising the amino acid sequence of SEQ ID NO:22, a heavy chain CDR2 comprising the amino acid sequence of SEQ ID NO:23, and a heavy chain CDR3 comprising the amino acid sequence of SEQ ID NO:24. In some embodiments, the antibody comprises a light chain CDR1 comprising the amino acid sequence of SEQ ID NO:42, a light chain CDR2 comprising the amino acid sequence of SEQ ID NO:43, and a light chain CDR3 comprising the amino acid sequence of SEQ ID NO:46. In some embodiments, the antibody comprises a heavy chain CDR1 comprising the amino acid sequence of SEQ ID NO:22, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:42, a light chain CDR2 comprising the amino acid sequence of SEQ ID NO:43, and a light chain CDR3 comprising the amino acid sequence of SEQ ID NO:46.

In some embodiments, the antibody comprises a heavy chain variable region comprising an amino acid sequence that has at least 90% sequence identity (90%, 92%, 94%, 96%, 98%, 99%, or 100% sequence identity) to any one of SEQ ID NOS:21 and 40. In some embodiments, the antibody comprises a light chain variable region comprising an amino acid sequence that has at least 90% sequence identity (90%, 92%, 94%, 96%, 98%, 99%, or 100% sequence identity) to any one of SEQ ID NOS:25, 41, and 45. In some embodiments, the antibody comprises a heavy chain variable region comprising an amino acid sequence that has at least 90% sequence identity (90%, 92%, 94%, 96%, 98%, 99%, or 100% sequence identity) to SEQ ID NO:21 and a light chain variable region comprising an amino acid sequence that has at least 90% sequence identity (90%, 92%, 94%, 96%, 98%, 99%, or 100% sequence identity) to SEQ ID NO:25. In some embodiments, the antibody comprises a heavy chain variable region comprising an amino acid sequence that has at least 90% sequence identity (90%, 92%, 94%, 96%, 98%, 99%, or 100% sequence identity) to SEQ ID NO:40 and a light chain variable region comprising an amino acid sequence that has at least 90% sequence identity (90%, 92%, 94%, 96%, 98%, 99%, or 100% sequence identity) to SEQ ID NO:41. In some embodiments, the antibody comprises a heavy chain variable region comprising an amino acid sequence that has at least 90% sequence identity (90%, 92%, 94%, 96%, 98%, 99%, or 100% sequence identity) to SEQ ID NO:40 and a light chain variable region comprising an amino acid sequence that has at least 90% sequence identity (90%, 92%, 94%, 96%, 98%, 99%, or 100% sequence identity) to SEQ ID NO:45.

In some embodiments, the antibody comprises one or more complementary determining regions (CDRs) selected from the group consisting of:
(a) a heavy chain CDR1 having at least 90% sequence identity (90%, 92%, 94%, 96%, 98%, 99%, or 100% sequence identity) to the amino acid sequence of any one of SEQ ID NOS:22, 150-154, 420-437, 586, 587, 617, and 620 or having up to two amino acid substitutions relative to the amino acid sequence of any one of SEQ ID NOS:22, 150-154, 420-437, 586, 587, 617, and 620;
(b) a heavy chain CDR2 having at least 90% sequence identity (90%, 92%, 94%, 96%, 98%, 99%, or 100% sequence identity) to the amino acid sequence of any one of SEQ ID NOS:23, 438-443, 588, and 621 or having up to two amino acid substitutions relative to the amino acid sequence of any one of SEQ ID NOS: 23, 438-443, 588, and 621;
(c) a heavy chain CDR3 having at least 90% sequence identity (90%, 92%, 94%, 96%, 98%, 99%, or 100% sequence identity) to the amino acid sequence of any one of SEQ ID NOS:24, 155, and 622 or having up to two amino acid substitutions relative to the amino acid sequence of any one of SEQ ID NOS:24, 155, and 622;
(d) a light chain CDR1 having at least 90% sequence identity (90%, 92%, 94%, 96%, 98%, 99%, or 100% sequence identity) to the amino acid sequence of any one of SEQ ID NOS:26, 156-158, 444-459, and 618 or having up to two amino acid substitutions relative to the amino acid sequence of any one of SEQ ID NOS: 26, 156-158, 444-459, and 618;
(e) a light chain CDR2 having at least 90% sequence identity (90%, 92%, 94%, 96%, 98%, 99%, or 100% sequence identity) to the amino acid sequence of SEQ ID NO:27 and 623 or having up to two amino acid substitutions relative to the amino acid sequence of SEQ ID NO:27 and 623; and
(f) a light chain CDR3 having at least 90% sequence identity (90%, 92%, 94%, 96%, 98%, 99%, or 100% sequence identity) to the amino acid sequence of any one of SEQ ID NOS:28, 159-162, 460-462, 619, and 624 or having up to two amino acid substitutions relative to the amino acid sequence of any one of SEQ ID NOS:28, 159-162, 460-462, 619, and 624.

In some embodiments, the antibody comprises one or more CDRs selected from the group consisting of:
(a) a heavy chain CDR1 comprising the amino acid sequence of any one of SEQ ID NOS:22, 150-154, 420-437, 586, 587, 617, and 620;
(b) a heavy chain CDR2 comprising the amino acid sequence of any one of SEQ ID NOS:23, 438-443, 588, and 621;
(c) a heavy chain CDR3 comprising the amino acid sequence of any one of SEQ ID NOS:24, 155, and 622;
(d) a light chain CDR1 comprising the amino acid sequence of any one of SEQ ID NOS:26, 156-158, 444-459, and 618;
(e) a light chain CDR2 comprising the amino acid sequence of SEQ ID NO:27 and 623; and
(f) a light chain CDR3 comprising the amino acid sequence of any one of SEQ ID NOS:28, 159-162, 460-462, 619, and 624.

In some embodiments, the antibody comprises a heavy chain CDR1 comprising the amino acid sequence of any one of SEQ ID NOS:22, 150-154, 420-437, 586, 587, and 620; a heavy chain CDR2 comprising the amino acid sequence of any one of SEQ ID NOS:23, 438-443, 588, and 621; and a heavy chain CDR3 comprising the amino acid sequence of any one of SEQ ID NOS:24, 155, and 622.

In some embodiments, the antibody comprises a light chain CDR1 comprising the amino acid sequence of any one of SEQ ID NOS:26, 156-158, 444-459, and 618; a light chain CDR2 comprising the amino acid sequence of SEQ ID NO:27 and 623; and a light chain CDR3 comprising the amino acid sequence of any one of SEQ ID NOS:28, 159-162, 460-462, 619, and 624.

In some embodiments, the antibody comprises a heavy chain CDR1 comprising the amino acid sequence of SEQ ID NO:22, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:450, a light chain CDR2 comprising the amino acid sequence of SEQ ID NO:27, and a light chain CDR3 comprising the amino acid sequence of SEQ ID NO:461.

In some embodiments, the antibody comprises a heavy chain CDR1 comprising the amino acid sequence of SEQ ID NO:22, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:459, a light chain CDR2 comprising the amino acid sequence of SEQ ID NO:27, and a light chain CDR3 comprising the amino acid sequence of SEQ ID NO:461.

In some embodiments, the antibody comprises a heavy chain CDR1 comprising the amino acid sequence of SEQ ID NO:151, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:26, a light chain CDR2 comprising the amino acid sequence of any one of SEQ ID NO:27, and a light chain CDR3 comprising the amino acid sequence of SEQ ID NO:28.

In some embodiments, the antibody comprises a heavy chain CDR1 comprising the amino acid sequence of SEQ ID NO:151, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:156, a light chain CDR2 comprising the amino acid sequence of SEQ ID NO:27, and a light chain CDR3 comprising the amino acid sequence of SEQ ID NO:28.

In some embodiments, the antibody comprises a heavy chain CDR1 comprising the amino acid sequence of SEQ ID NO:151, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:28.

In some embodiments, the antibody comprises a heavy chain CDR1 comprising the amino acid sequence of SEQ ID NO:22, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:158, a light chain CDR2 comprising the amino acid sequence of any one of SEQ ID NO:27, and a light chain CDR3 comprising the amino acid sequence of SEQ ID NO:28.

In some embodiments, the antibody comprises a heavy chain CDR1 comprising the amino acid sequence of SEQ ID NO:150, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:28.

In some embodiments, the antibody comprises a heavy chain CDR1 comprising the amino acid sequence of SEQ ID NO:153, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:28.

In some embodiments, the antibody comprises a heavy chain CDR1 comprising the amino acid sequence of SEQ ID NO:154, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:28.

In some embodiments, the antibody comprises a heavy chain CDR1 comprising the amino acid sequence of SEQ ID NO:22, a heavy chain CDR2 comprising the amino acid sequence of SEQ ID NO:23, a heavy chain CDR3 comprising the amino acid sequence of SEQ ID NO:155, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:28.

In some embodiments, the antibody comprises a heavy chain CDR1 comprising the amino acid sequence of SEQ ID NO:150, a heavy chain CDR2 comprising the amino acid sequence of SEQ ID NO:23, a heavy chain CDR3 comprising the amino acid sequence of SEQ ID NO:155, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:28.

In some embodiments, the antibody comprises a heavy chain CDR1 comprising the amino acid sequence of SEQ ID NO:151, a heavy chain CDR2 comprising the amino acid sequence of SEQ ID NO:23, a heavy chain CDR3 comprising the amino acid sequence of SEQ ID NO:155, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:28.

In some embodiments, the antibody comprises a heavy chain CDR1 comprising the amino acid sequence of SEQ ID NO:153, a heavy chain CDR2 comprising the amino acid sequence of SEQ ID NO:23, a heavy chain CDR3 comprising the amino acid sequence of SEQ ID NO:155, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:28.

In some embodiments, the antibody comprises a heavy chain CDR1 comprising the amino acid sequence of SEQ ID NO:154, a heavy chain CDR2 comprising the amino acid sequence of SEQ ID NO:23, a heavy chain CDR3 comprising the amino acid sequence of SEQ ID NO:155, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:28.

In some embodiments, the antibody comprises a heavy chain variable region comprising an amino acid sequence that has at least 90% sequence identity (90%, 92%, 94%, 96%, 98%, 99%, or 100% sequence identity) to any one of SEQ ID NOS:145-148.

In some embodiments, the antibody comprises a light chain variable region comprising an amino acid sequence that has at least 90% sequence identity (90%, 92%, 94%, 96%, 98%, 99%, or 100% sequence identity) to SEQ ID NO:149.

In some embodiments, the antibody comprises a heavy chain variable region comprising an amino acid sequence that has at least 90% sequence identity (90%, 92%, 94%, 96%, 98%, 99%, or 100% sequence identity) to SEQ ID NO:145 and a light chain variable region comprising an amino acid sequence that has at least 90% sequence identity (90%, 92%, 94%, 96%, 98%, 99%, or 100% sequence identity) to SEQ ID NO:149.

In some embodiments, the antibody comprises a heavy chain variable region comprising an amino acid sequence that has at least 90% sequence identity (90%, 92%, 94%, 96%, 98%, 99%, or 100% sequence identity) to SEQ ID NO:146 and a light chain variable region comprising an amino acid sequence that has at least 90% sequence identity (90%, 92%, 94%, 96%, 98%, 99%, or 100% sequence identity) to SEQ ID NO:149.

In some embodiments, the antibody comprises a heavy chain variable region comprising an amino acid sequence that has at least 90% sequence identity (90%, 92%, 94%, 96%, 98%, 99%, or 100% sequence identity) to SEQ ID NO:147 and a light chain variable region comprising an amino acid sequence that has at least 90% sequence identity (90%, 92%, 94%, 96%, 98%, 99%, or 100% sequence identity) to SEQ ID NO:149.

In some embodiments, the antibody comprises a heavy chain variable region comprising an amino acid sequence that has at least 90% sequence identity (90%, 92%, 94%, 96%, 98%, 99%, or 100% sequence identity) to SEQ ID NO:148 and a light chain variable region comprising an amino acid sequence that has at least 90% sequence identity (90%, 92%, 94%, 96%, 98%, 99%, or 100% sequence identity) to SEQ ID NO:149.

In some embodiments, the antibody comprises a heavy chain variable region comprising an amino acid sequence that has at least 90% sequence identity (90%, 92%, 94%, 96%, 98%, 99%, or 100% sequence identity) to SEQ ID NO:146 and a light chain variable region comprising an amino acid sequence that has at least 90% sequence identity (90%, 92%, 94%, 96%, 98%, 99%, or 100% sequence identity) to SEQ ID NO:463.

In some embodiments, the antibody comprises a heavy chain variable region comprising an amino acid sequence that has at least 90% sequence identity (90%, 92%, 94%, 96%, 98%, 99%, or 100% sequence identity) to SEQ ID NO:146 and a light chain variable region comprising an amino acid sequence that has at least 90% sequence identity (90%, 92%, 94%, 96%, 98%, 99%, or 100% sequence identity) to SEQ ID NO:464.

In some embodiments, the antibody comprises one or more complementarity determining regions (CDRs) selected from the group consisting of: (a) a heavy chain CDR1 having at least 90% sequence identity (90%, 92%, 94%, 96%, 98%, 99%, or 100% sequence identity) to the amino acid sequence of any one of SEQ ID NOS:151, 153, 426-430, 432-437, 586, and 587 or having up to two amino acid substitutions relative to the amino acid sequence of any one of SEQ ID NOS: 151, 153, 426-430, 432-437, 586, and 587; (b) a heavy chain CDR2 having at least 90% sequence identity (90%, 92%, 94%, 96%, 98%, 99%, or 100% sequence identity) to the amino acid sequence of any one of SEQ ID NOS:23 and 588 or having up to two amino acid substitutions relative to the amino acid sequence of any one of SEQ ID NOS:23 and 588; (c) a heavy chain CDR3 having at least 90% sequence identity (90%, 92%, 94%, 96%, 98%, 99%, or 100% sequence identity) to the amino acid sequence of SEQ ID NO:24 or having up to two amino acid substitutions relative to the amino acid sequence of SEQ ID NO:24; (d) a light chain CDR1 having at least 90% sequence identity (90%, 92%, 94%, 96%, 98%, 99%, or 100% sequence identity) to the amino acid sequence of any one of SEQ ID NOS:158 and 448-458 or having up to two amino acid substitutions relative to the amino acid sequence of any one of SEQ ID NOS:158 and 448-458; (e) a light chain CDR2 having at least 90% sequence identity (90%, 92%, 94%, 96%, 98%, 99%, or 100% sequence identity) to the amino acid sequence of SEQ ID NO:27 or having up to two amino acid substitutions relative to the amino acid sequence of SEQ ID NO:27; and (f) a light chain CDR3 having at least 90% sequence identity (90%, 92%, 94%, 96%, 98%, 99%, or 100% sequence identity) to the amino acid sequence of any one of SEQ ID NOS:28 and 461 or having up to two amino acid substitutions relative to the amino acid sequence of any one of SEQ ID NOS:28 and 461.

In some embodiments, the antibody comprises one or more CDRs selected from the group consisting of: (a) a heavy chain CDR1 comprising the amino acid sequence of any one of SEQ ID NOS:151, 153, 426-430, 432-437, 586, and 587; (b) a heavy chain CDR2 comprising the amino acid sequence of any one of SEQ ID NOS:23 and 588; (c) a heavy chain CDR3 comprising the amino acid sequence of SEQ ID NO:24; (d) a light chain CDR1 comprising the amino acid sequence of any one of SEQ ID NOS:158 and 448-458; (e) a light chain CDR2 comprising the amino acid sequence of SEQ ID NO:27; and (f) a light chain CDR3 comprising the amino acid sequence of any one of SEQ ID NOS:28 and 461.

In some embodiments, the antibody comprises (a) a heavy chain CDR1 comprising the amino acid sequence of any one of SEQ ID NOS:151, 153, 426-430, 432-437, 586, and 587; (b) a heavy chain CDR2 comprising the amino acid sequence of any one of SEQ ID NOS:23 and 588; and (c) a heavy chain CDR3 comprising the amino acid sequence of SEQ ID NO:24.

In some embodiments, the antibody comprises (a) a light chain CDR1 comprising the amino acid sequence of any one of SEQ ID NOS:158 and 448-458; (b) a light chain CDR2 comprising the amino acid sequence of SEQ ID NO:27; and (c) a light chain CDR3 comprising the amino acid sequence of any one of SEQ ID NOS:28 and 461.

In some embodiments, the antibody comprises (a) a heavy chain CDR1 comprising the amino acid sequence of any one of SEQ ID NOS:151, 153, 426-430, 432-437, 586, and 587; (b) a heavy chain CDR2 comprising the amino acid sequence of any one of SEQ ID NOS:23 and 588; (c) a heavy chain CDR3 comprising the amino acid sequence of SEQ ID NO:24; (d) a light chain CDR1 comprising the amino acid sequence of any one of SEQ ID NOS:158 and 448-458; (e) a light chain CDR2 comprising the amino acid sequence of SEQ ID NO:27; and (f) a light chain CDR3 comprising the amino acid sequence of any one of SEQ ID NOS:28 and 461.

In some embodiments, an antibody (or antigen-binding portion thereof) that specifically binds to a human Tau protein recognizes an epitope within residues 251-270 and/or residues 346-360 of SEQ ID NO:1. In some embodiments, the antibody recognizes an epitope within residues 251-270 of SEQ ID NO:1. In some embodiments, the antibody recognizes an epitope within residues 346-360 of SEQ ID NO:1. In some embodiments, the antibody recognizes both an epitope within residues 251-270 of SEQ ID NO:1 and recognizes an epitope within residues 346-360 of SEQ ID NO:1. In some embodiments, the antibody recognizes an epitope within residues 256-270 of SEQ ID NO:1. In some embodiments, the antibody recognizes an epitope comprising the sequence SKIGS within residues 251-270 and/or residues 346-360 of SEQ ID NO:1.

In some embodiments, the antibody comprises one or more (e.g., one, two, three, four, five, or all six) CDRs selected from the group consisting of:
  (a) a heavy chain CDR1 having at least 90% sequence identity (90%, 92%, 94%, 96%, 98%, 99%, or 100% sequence identity) to the amino acid sequence of any one of SEQ ID NOS:9, 17, and 47 or having up to two amino acid substitutions relative to the amino acid sequence of any one of SEQ ID NOS:9, 17, and 47;
  (b) a heavy chain CDR2 having at least 90% sequence identity (90%, 92%, 94%, 96%, 98%, 99%, or 100% sequence identity) to the amino acid sequence of SEQ ID NO:10 or having up to two amino acid substitutions relative to the amino acid sequence of SEQ ID NO:10;
  (c) a heavy chain CDR3 having at least 90% sequence identity (90%, 92%, 94%, 96%, 98%, 99%, or 100% sequence identity) to the amino acid sequence of any one of SEQ ID NOS:11, 18, 30, 33, and 48 or having up to two amino acid substitutions relative to the amino acid sequence of any one of SEQ ID NOS:11, 18, 30, 33, and 48;
  (d) a light chain CDR1 having at least 90% sequence identity (90%, 92%, 94%, 96%, 98%, 99%, or 100% sequence identity) to the amino acid sequence of SEQ ID NO:13 or having up to two amino acid substitutions relative to the amino acid sequence of SEQ ID NO:13;
  (e) a light chain CDR2 having at least 90% sequence identity (90%, 92%, 94%, 96%, 98%, 99%, or 100% sequence identity) to the amino acid sequence of SEQ ID NO:14 or having up to two amino acid substitutions relative to the amino acid sequence of SEQ ID NO:14; and
  (f) a light chain CDR3 having at least 90% sequence identity (90%, 92%, 94%, 96%, 98%, 99%, or 100% sequence identity) to the amino acid sequence of any one of SEQ ID NOS:15, 20, and 49 or having up to two amino acid substitutions relative to the amino acid sequence of any one of SEQ ID NOS:15, 20, and 49.

In some embodiments, the antibody comprises one or more (e.g., one, two, three, four, five, or all six) CDRs selected from the group consisting of:
  (a) a heavy chain CDR1 comprising the amino acid sequence of any one of SEQ ID NOS:9, 17, and 47;
  (b) a heavy chain CDR2 comprising the amino acid sequence of SEQ ID NO:10;
  (c) a heavy chain CDR3 comprising the amino acid sequence of any one of SEQ ID NOS:11, 18, 30, 33, and 48;
  (d) a light chain CDR1 comprising the amino acid sequence of SEQ ID NO:13;
  (e) a light chain CDR2 comprising the amino acid sequence of SEQ ID NO:14; and
  (f) a light chain CDR3 comprising the amino acid sequence of any one of SEQ ID NOS:15, 20, and 49.

In some embodiments, the antibody comprises a heavy chain CDR1 comprising the amino acid sequence of SEQ ID NO:9, a heavy chain CDR2 comprising the amino acid sequence of SEQ ID NO:10, and a heavy chain CDR3 comprising the amino acid sequence of SEQ ID NO:11. In some embodiments, the antibody comprises a light chain CDR1 comprising the amino acid sequence of SEQ ID NO:13, a light chain CDR2 comprising the amino acid sequence of SEQ ID NO:14, and a light chain CDR3 comprising the amino acid sequence of SEQ ID NO:15. In some embodiments, the antibody comprises a heavy chain CDR1 comprising the amino acid sequence of SEQ ID NO:9, a heavy chain CDR2 comprising the amino acid sequence of SEQ ID NO:10, a heavy chain CDR3 comprising the amino acid sequence of SEQ ID NO:11, a light chain CDR1 comprising the amino acid sequence of SEQ ID NO:13, a light chain CDR2 comprising the amino acid sequence of SEQ ID NO:14, and a light chain CDR3 comprising the amino acid sequence of SEQ ID NO:15.

In some embodiments, the antibody comprises a heavy chain CDR1 comprising the amino acid sequence of SEQ ID NO:17, a heavy chain CDR2 comprising the amino acid sequence of SEQ ID NO:10, and a heavy chain CDR3 comprising the amino acid sequence of SEQ ID NO:18. In some embodiments, the antibody comprises a light chain CDR1 comprising the amino acid sequence of SEQ ID NO:13, a light chain CDR2 comprising the amino acid sequence of SEQ ID NO:14, and a light chain CDR3 comprising the amino acid sequence of SEQ ID NO:20. In some embodiments, the antibody comprises a heavy chain CDR1 comprising the amino acid sequence of SEQ ID NO:17, a heavy chain CDR2 comprising the amino acid sequence of SEQ ID NO:10, a heavy chain CDR3 comprising the amino acid sequence of SEQ ID NO:18, a light chain CDR1 comprising the amino acid sequence of SEQ ID NO:13, a light chain CDR2 comprising the amino acid sequence of SEQ ID NO:14, and a light chain CDR3 comprising the amino acid sequence of SEQ ID NO:20.

In some embodiments, the antibody comprises a heavy chain CDR1 comprising the amino acid sequence of SEQ ID NO:9, a heavy chain CDR2 comprising the amino acid sequence of SEQ ID NO:10, and a heavy chain CDR3 comprising the amino acid sequence of SEQ ID NO:30. In some embodiments, the antibody comprises a light chain CDR1 comprising the amino acid sequence of SEQ ID NO:13, a light chain CDR2 comprising the amino acid sequence of SEQ ID NO:14, and a light chain CDR3 comprising the amino acid sequence of SEQ ID NO:20. In some embodiments, the antibody comprises a heavy chain CDR1 comprising the amino acid sequence of SEQ ID NO:9, a heavy chain CDR2 comprising the amino acid sequence of SEQ ID NO:10, a heavy chain CDR3 comprising the amino acid sequence of SEQ ID NO:30, a light chain CDR1 comprising the amino acid sequence of SEQ ID NO:13, a light chain CDR2 comprising the amino acid sequence of SEQ ID NO:14, and a light chain CDR3 comprising the amino acid sequence of SEQ ID NO:20.

In some embodiments, the antibody comprises a heavy chain CDR1 comprising the amino acid sequence of SEQ ID NO:9, a heavy chain CDR2 comprising the amino acid sequence of SEQ ID NO:10, and a heavy chain CDR3 comprising the amino acid sequence of SEQ ID NO:33. In some embodiments, the antibody comprises a light chain CDR1 comprising the amino acid sequence of SEQ ID NO:13, a light chain CDR2 comprising the amino acid sequence of SEQ ID NO:14, and a light chain CDR3 comprising the amino acid sequence of SEQ ID NO:20. In some embodiments, the antibody comprises a heavy chain CDR1 comprising the amino acid sequence of SEQ ID NO:9, a heavy chain CDR2 comprising the amino acid sequence of SEQ ID NO:10, a heavy chain CDR3 comprising the amino acid sequence of SEQ ID NO:33, a light chain CDR1 comprising the amino acid sequence of SEQ ID NO:13, a light chain CDR2 comprising the amino acid sequence of SEQ ID NO:14, and a light chain CDR3 comprising the amino acid sequence of SEQ ID NO:20.

In some embodiments, the antibody comprises a heavy chain variable region comprising an amino acid sequence that has at least 90% sequence identity (90%, 92%, 94%, 96%, 98%, 99%, or 100% sequence identity) to any one of SEQ ID NOS:8, 16, 29, and 32. In some embodiments, the antibody comprises a light chain variable region comprising an amino acid sequence that has at least 90% sequence identity (90%, 92%, 94%, 96%, 98%, 99%, or 100% sequence identity) to any one of SEQ ID NOS:12, 19, 31, and 34. In some embodiments, the antibody comprises a heavy chain variable region comprising an amino acid sequence that has at least 90% sequence identity (90%, 92%, 94%, 96%, 98%, 99%, or 100% sequence identity) to any one of SEQ ID NOS:8, 16, 29, and 32, and a light chain variable region comprising an amino acid sequence that has at least 90% sequence identity (90%, 92%, 94%, 96%, 98%, 99%, or 100% sequence identity) to any one of SEQ ID NOS:12, 19, 31, and 34. In some embodiments, the antibody comprises an amino acid sequence that has at least 90% sequence identity (90%, 92%, 94%, 96%, 98%, 99%, or 100% sequence identity) to SEQ ID NO:8 and a light chain variable region comprising an amino acid sequence that has at least 90% sequence identity (90%, 92%, 94%, 96%, 98%, 99%, or 100% sequence identity) to SEQ ID NO:12. In some embodiments, the antibody comprises a heavy chain variable region comprising an amino acid sequence that has at least 90% sequence identity (90%, 92%, 94%, 96%, 98%, 99%, or 100% sequence identity) to SEQ ID NO:16 and a light chain variable region comprising an amino acid sequence that has at least 90% sequence identity (90%, 92%, 94%, 96%, 98%, 99%, or 100% sequence identity) to SEQ ID NO:19. In some embodiments, the antibody comprises a heavy chain variable region comprising an amino acid sequence that has at least 90% sequence identity (90%, 92%, 94%, 96%, 98%, 99%, or 100% sequence identity) to SEQ ID NO:29 and a light chain variable region comprising an amino acid sequence that has at least 90% sequence identity (90%, 92%, 94%, 96%, 98%, 99%, or 100% sequence identity) to SEQ ID NO:31. In some embodiments, the antibody comprises a heavy chain variable region comprising an amino acid sequence that has at least 90% sequence identity (90%, 92%, 94%, 96%, 98%, 99%, or 100% sequence identity) to SEQ ID NO:32 and a light chain variable region comprising an amino acid sequence that has at least 90% sequence identity (90%, 92%, 94%, 96%, 98%, 99%, or 100% sequence identity) to SEQ ID NO:34.

In another aspect, an isolated antibody or antigen-binding portion thereof that specifically binds to a human Tau protein and recognizes an epitope within residues 186-205 of SEQ ID NO:1 is provided. In some embodiments, the antibody or antigen-binding portion thereof recognizes an epitope within residues 186-200 or residues 191-205 of SEQ ID NO:1.

In some embodiments, the antibody comprises one or more complementarity determining regions (CDRs) selected from the group consisting of:

(a) a heavy chain CDR1 having at least 90% sequence identity (90%, 92%, 94%, 96%, 98%, 99%, or 100% sequence identity) to the amino acid sequence of SEQ ID NO:168 or having up to two amino acid substitutions relative to the amino acid sequence of SEQ ID NO:168;

(b) a heavy chain CDR2 having at least 90% sequence identity (90%, 92%, 94%, 96%, 98%, 99%, or 100% sequence identity) to the amino acid sequence of SEQ ID NO:169 or having up to two amino acid substitutions relative to the amino acid sequence of SEQ ID NO:169;

(c) a heavy chain CDR3 having at least 90% sequence identity (90%, 92%, 94%, 96%, 98%, 99%, or 100% sequence identity) to the amino acid sequence of SEQ ID NO:170 or having up to two amino acid substitutions relative to the amino acid sequence of SEQ ID NO:170;

(d) a light chain CDR1 having at least 90% sequence identity (90%, 92%, 94%, 96%, 98%, 99%, or 100% sequence identity) to the amino acid sequence of SEQ ID NO:172 or having up to two amino acid substitutions relative to the amino acid sequence of SEQ ID NO:172;

(e) a light chain CDR2 having at least 90% sequence identity (90%, 92%, 94%, 96%, 98%, 99%, or 100% sequence identity) to the amino acid sequence of SEQ ID NO:173 or having up to two amino acid substitutions relative to the amino acid sequence of any one of SEQ ID NO:173; and (f) a light chain CDR3 having at least 90% sequence identity (90%, 92%, 94%, 96%, 98%, 99%, or 100% sequence identity) to the amino acid sequence of SEQ ID NO:174 or having up to two amino acid substitutions relative to the amino acid sequence of any one of SEQ ID NO:174.

In some embodiments, the antibody comprises one or more CDRs selected from the group consisting of: a heavy chain CDR1 comprising the amino acid sequence of SEQ ID NO:168; a heavy chain CDR2 comprising the amino acid sequence of SEQ ID NO:169; a heavy chain CDR3 comprising the amino acid sequence of SEQ ID NO:170; a light chain CDR1 comprising the amino acid sequence of SEQ ID NO:172; a light chain CDR2 comprising the amino acid sequence of SEQ ID NO:173; and a light chain CDR3 comprising the amino acid sequence of SEQ ID NO:174. In some embodiments, the antibody comprises a heavy chain CDR1 comprising the amino acid sequence of SEQ ID NO:168; a heavy chain CDR2 comprising the amino acid sequence of SEQ ID NO:169; and a heavy chain CDR3 comprising the amino acid sequence of SEQ ID NO:170. In some embodiments, the antibody comprises a light chain CDR1 comprising the amino acid sequence of SEQ ID NO:172; a light chain CDR2 comprising the amino acid sequence of SEQ ID NO:173; and a light chain CDR3 comprising the amino acid sequence of SEQ ID NO:174.

In some embodiments, the antibody comprises a heavy chain CDR1 comprising the amino acid sequence of SEQ ID NO:168, a heavy chain CDR2 comprising the amino acid sequence of SEQ ID NO:169, a heavy chain CDR3 comprising the amino acid sequence of SEQ ID NO:170, a light chain CDR1 comprising the amino acid sequence of SEQ ID NO:172, a light chain CDR2 comprising the amino acid sequence of SEQ ID NO:173, and a light chain CDR3 comprising the amino acid sequence of SEQ ID NO:174.

In some embodiments, the antibody comprises a heavy chain variable region comprising an amino acid sequence that has at least 90% sequence identity (90%, 92%, 94%, 96%, 98%, 99%, or 100% sequence identity) to SEQ ID NO:167. In some embodiments, the antibody comprises a light chain variable region comprising an amino acid sequence that has at least 90% sequence identity (90%, 92%, 94%, 96%, 98%, 99%, or 100% sequence identity) to SEQ ID NO:171. In some embodiments, the antibody comprises a heavy chain variable region comprising an amino acid sequence that has at least 90% sequence identity (90%, 92%, 94%, 96%, 98%, 99%, or 100% sequence identity) to SEQ ID NO:167 and a light chain variable region comprising an amino acid sequence that has at least 90% sequence identity (90%, 92%, 94%, 96%, 98%, 99%, or 100% sequence identity) to SEQ ID NO:171.

In another aspect, an isolated antibody or antigen-binding portion thereof that specifically binds to a human Tau protein and recognizes an epitope that is the same or substantially the same as the epitope recognized by antibody clone 19F7.C9 or 24D2.B2 is provided. In some embodiments, the epitope recognized by antibody clone 19F7.C9 or 24D2.B2 comprises one or more residues within residues 50-421 of SEQ ID NO:1. In some embodiments, the epitope recognized by antibody clone 19F7.C9 or 24D2.B2 is within residues 50-421 of SEQ ID NO:1.

In some embodiments, in any of the anti-Tau antibodies described herein, the antibody comprises a first Fc polypeptide and optionally a second Fc polypeptide. In some embodiments, the antibody comprises a first Fc polypeptide and a second Fc polypeptide. In some embodiments, the first Fc polypeptide is a modified Fc polypeptide and/or the second Fc polypeptide is a modified Fc polypeptide.

In some embodiments, in any of the anti-Tau antibodies described herein, the antibody comprises:
(a) a first antigen-binding portion comprising a first variable region that specifically binds to the human Tau protein, wherein the first antigen-binding portion comprises (i) a first heavy chain comprising a first Fc polypeptide and (ii) a first light chain; and
(b) a second antigen-binding portion comprising a second variable region that specifically binds to the human Tau protein, wherein the second antigen-binding portion comprises (i) a second heavy chain comprising a second Fc polypeptide and (ii) a second light chain;
wherein the first Fc polypeptide and the second Fc polypeptide form an Fc dimer.

In some embodiments, the first Fc polypeptide is a modified Fc polypeptide and/or the second Fc polypeptide is a modified Fc polypeptide.

In some embodiments, the first and second variable regions recognize the same epitope in the human Tau protein. In other embodiments, the first and second variable regions recognize different epitopes in the human Tau protein.

In some embodiments, the first Fc polypeptide and the second Fc polypeptide each contain modifications that promote heterodimerization. In some embodiments, one of the Fc polypeptides has a T366W substitution and the other Fc polypeptide has T366S, L368A, and Y407V substitutions, according to EU numbering.

In some embodiments, the first Fc polypeptide and/or the second Fc polypeptide comprises a native FcRn binding site. In some embodiments, the first Fc polypeptide and/or the second Fc polypeptide comprises a modification that alters FcRn binding.

In some embodiments, the first Fc polypeptide and the second Fc polypeptide do not have effector function. In some embodiments, the first Fc polypeptide and/or the second Fc polypeptide includes a modification that reduces effector function. In some embodiments, the modifications that reduce effector function comprise the substitutions of Ala at position 234 and Ala at position 235, according to EU numbering.

In some embodiments, the first Fc polypeptide and/or the second Fc polypeptide comprises amino acid changes relative to the native Fc sequence that extend serum half-life. In some embodiments, the amino acid changes comprise substitutions of Tyr at position 252, Thr at position 254, and Glu at position 256, according to EU numbering. Alternatively, in other embodiments, the amino acid changes comprise substitutions of Leu at position 428 and Ser at position 434, according to EU numbering. Alternatively, in further embodiments, the amino acid changes comprise a substitution of Ser or Ala at position 434, according to EU numbering.

In some embodiments, the first Fc polypeptide and/or the second Fc polypeptide specifically binds to a transferrin receptor. In some embodiments, the first Fc polypeptide and/or the second Fc polypeptide comprises at least two substitutions at positions selected from the group consisting of 384, 386, 387, 388, 389, 390, 413, 416, and 421, according to EU numbering. In some embodiments, the first Fc polypeptide and/or the second Fc polypeptide comprises substitutions at at least three, four, five, six, seven, eight, or nine of the positions.

In some embodiments, the first Fc polypeptide and/or the second Fc polypeptide further comprises one, two, three, or four substitutions at positions comprising 380, 391, 392, and 415, according to EU numbering. In some embodiments, the first Fc polypeptide and/or the second Fc polypeptide further comprises one, two, or three substitutions at positions comprising 414, 424, and 426, according to EU numbering.

In some embodiments, the first Fc polypeptide and/or the second Fc polypeptide comprises Trp at position 388. In some embodiments, the first Fc polypeptide and/or the second Fc polypeptide comprises an aromatic amino acid at position 421. In some embodiments, the aromatic amino acid at position 421 is Trp or Phe.

In some embodiments, the first Fc polypeptide and/or the second Fc polypeptide comprises at least one position selected from the following: position 380 is Trp, Leu, or Glu; position 384 is Tyr or Phe; position 386 is Thr; position 387 is Glu; position 388 is Trp; position 389 is Ser, Ala, Val, or Asn; position 390 is Ser or Asn; position 413 is Thr or Ser; position 415 is Glu or Ser; position 416 is Glu; and position 421 is Phe.

In some embodiments, the first Fc polypeptide and/or the second Fc polypeptide comprises 2, 3, 4, 5, 6, 7, 8, 9, 10, or 11 positions selected from the following: position 380 is Trp, Leu, or Glu; position 384 is Tyr or Phe; position 386 is Thr; position 387 is Glu; position 388 is Trp; position 389 is Ser, Ala, Val, or Asn; position 390 is Ser or Asn; position 413 is Thr or Ser; position 415 is Glu or Ser; position 416 is Glu; and position 421 is Phe.

In some embodiments, the first Fc polypeptide and/or the second Fc polypeptide comprises 11 positions as follows: position 380 is Trp, Leu, or Glu; position 384 is Tyr or Phe; position 386 is Thr; position 387 is Glu; position 388 is Trp; position 389 is Ser, Ala, Val, or Asn; position 390 is Ser or Asn; position 413 is Thr or Ser; position 415 is Glu or Ser; position 416 is Glu; and position 421 is Phe.

In some embodiments, the first Fc polypeptide and/or the second Fc polypeptide has a CH3 domain with at least 85% identity, at least 90% identity, or at least 95% identity to amino acids 111-217 of any one of SEQ ID NOS:214-218, 238, 240-270, and 469-475. In some embodiments, the residues at at least 5, 6, 7, 8, 9, 10, 11, 12, 13, 14, 15, or 16 of the positions corresponding to EU index positions 380, 384, 386, 387, 388, 389, 390, 391, 392, 413, 414, 415, 416, 421, 424 and 426 of any one of SEQ ID NOS:214-218, 238, 240-270, and 469-475 are not deleted or substituted.

In some embodiments, the antibody comprises a first Fc polypeptide having the sequence of any one of SEQ ID NOS:283-286 and 626-628. In some embodiments, the antibody comprises a second Fc polypeptide having the sequence of any one of SEQ ID NOS:279-282 and 629-631.

In some embodiments, in any of the anti-Tau antibodies described herein, the antibody comprises a first Fc polypeptide having the sequence of SEQ ID NO:271 and a second Fc polypeptide having the sequence of SEQ ID NO:279. In some embodiments, the anti-Tau antibody comprises a first Fc polypeptide having the sequence of SEQ ID NO:272 and a second Fc polypeptide having the sequence of SEQ ID NO:280. In some embodiments, the anti-Tau antibody comprises a first Fc polypeptide having the sequence of SEQ ID NO:273 and a second Fc polypeptide having the sequence of SEQ ID NO:281. In some embodiments, the anti-Tau antibody comprises a first Fc polypeptide having the sequence of SEQ ID NO:274 and a second Fc polypeptide having the sequence of SEQ ID NO:282.

In some embodiments, in any of the anti-Tau antibodies described herein, the antibody comprises a first Fc polypeptide having the sequence of SEQ ID NO:275 and a second Fc polypeptide having the sequence of SEQ ID NO:283. In some embodiments, the anti-Tau antibody comprises a first Fc polypeptide having the sequence of SEQ ID NO:276 and a second Fc polypeptide having the sequence of SEQ ID NO:284. In some embodiments, the anti-Tau antibody comprises a first Fc polypeptide having the sequence of SEQ ID NO:277 and a second Fc polypeptide having the sequence of SEQ ID NO:285. In some embodiments, the anti-Tau antibody comprises a first Fc polypeptide having the sequence of SEQ ID NO:278 and a second Fc polypeptide having the sequence of SEQ ID NO:286.

In some embodiments, in any of the anti-Tau antibodies described herein, the antibody comprises a first Fc polypeptide having the sequence of SEQ ID NO:271 and a second Fc polypeptide having the sequence of SEQ ID NO:275. In some embodiments, the anti-Tau antibody comprises a first Fc polypeptide having the sequence of SEQ ID NO:272 and a second Fc polypeptide having the sequence of SEQ ID NO:276. In some embodiments, the anti-Tau antibody comprises a first Fc polypeptide having the sequence of SEQ ID NO:273 and a second Fc polypeptide having the sequence of SEQ ID NO:277. In some embodiments, the anti-Tau antibody comprises a first Fc polypeptide having the sequence of SEQ ID NO:274 and a second Fc polypeptide having the sequence of SEQ ID NO:278.

In some embodiments, the first Fc polypeptide and/or the second Fc polypeptide of the antibody binds to the apical domain of the transferrin receptor. In some embodiments, the binding of the antibody or antigen-binding portion thereof to the transferrin receptor does not substantially inhibit binding of transferrin to the transferrin receptor.

In some embodiments, the first Fc polypeptide and/or the second Fc polypeptide has at least 75%, or at least 80%, 90%, 92%, or 95%, amino acid sequence identity to the corresponding wild-type Fc polypeptide (e.g., a wild-type Fc polypeptide that is a human IgG1, IgG2, IgG3, or IgG4 Fc polypeptide).

In some embodiments, uptake of the antibody or antigen-binding portion thereof into the brain is greater than the uptake of the antibody or antigen-binding portion thereof without the modifications in the first Fc polypeptide and/or the second Fc polypeptide that result in transferrin receptor binding. In some embodiments, uptake of the antibody or antigen-binding portion thereof into the brain is at least 2, 3, 4, 5, 6, 7, 8, 9, 10, 15, 20, 25, 30, 35, 40, 45, 50, 55, 60, 65, 70, 75, 80, 85, 90, 95, or 100-fold greater as compared to the uptake of the antibody or antigen-binding portion thereof without the modifications in the first Fc polypeptide and/or the second Fc polypeptide that result in transferrin receptor binding.

In other embodiments, one of the Fc polypeptides of the anti-Tau antibody is not modified to bind to a blood-brain barrier receptor and the other Fc polypeptide of the anti-Tau antibody is modified to specifically bind to a transferrin receptor.

In another aspect, the disclosure features an isolated antibody or antigen-binding portion thereof, comprising one or more CDRs selected from the group consisting of: (a) a heavy chain CDR1 comprising the amino acid sequence of SEQ ID NO:586; (b) a heavy chain CDR2 comprising the amino acid sequence of SEQ ID NO:588; (c) a heavy chain CDR3 comprising the amino acid sequence of SEQ ID NO:24; (d) a light chain CDR1 comprising the amino acid sequence of SEQ ID NO:158; (e) a light chain CDR2 comprising the amino acid sequence of SEQ ID NO:27; and (f) a light chain CDR3 comprising the amino acid sequence of SEQ ID NO:28. In some embodiments, the isolated antibody comprises (a) a heavy chain CDR1 comprising the amino acid sequence of SEQ ID NO:586; (b) a heavy chain CDR2 comprising the amino acid sequence of SEQ ID NO:588; (c) a heavy chain CDR3 comprising the amino acid sequence of SEQ ID NO:24; (d) a light chain CDR1 comprising the amino acid sequence of SEQ ID NO:158; (e) a light chain CDR2 comprising the amino acid sequence of SEQ ID NO:27; and (f) a light chain CDR3 comprising the amino acid sequence of SEQ ID NO:28. In some embodiments, the isolated antibody comprises a heavy chain variable region comprising an amino acid sequence that has at least 90% sequence identity (90%, 92%, 94%, 96%, 98%, 99%, or 100% sequence identity) to SEQ ID NO:602 and a light chain variable region comprising an amino acid sequence that has at least 90% sequence identity (90%, 92%, 94%, 96%, 98%, 99%, or 100% sequence identity) to SEQ ID NO:604. In some embodiments, the isolated antibody comprises a heavy chain variable region comprising the amino acid sequence of SEQ ID NO:602 and a light chain variable region comprising the amino acid sequence of SEQ ID NO:604.

In another aspect, the disclosure features an isolated antibody or antigen-binding portion thereof, comprising one or more CDRs selected from the group consisting of: (a) a heavy chain CDR1 comprising the amino acid sequence of SEQ ID NO:586; (b) a heavy chain CDR2 comprising the amino acid sequence of SEQ ID NO:588; (c) a heavy chain CDR3 comprising the amino acid sequence of SEQ ID NO:24; (d) a light chain CDR1 comprising the amino acid sequence of SEQ ID NO:158; (e) a light chain CDR2 comprising the amino acid sequence of SEQ ID NO:27; and (f) a light chain CDR3 comprising the amino acid sequence of SEQ ID NO:461. In some embodiments, the isolated antibody comprises (a) a heavy chain CDR1 comprising the amino acid sequence of SEQ ID NO:586; (b) a heavy chain CDR2 comprising the amino acid sequence of SEQ ID NO:588; (c) a heavy chain CDR3 comprising the amino acid sequence of SEQ ID NO:24; (d) a light chain CDR1 comprising the amino acid sequence of SEQ ID NO:158; (e) a light chain CDR2 comprising the amino acid sequence of SEQ ID NO:27; and (f) a light chain CDR3 comprising the amino acid sequence of SEQ ID NO:461. In some embodiments, the isolated antibody comprises a heavy chain variable region comprising an amino acid sequence that has at least 90% sequence identity (90%, 92%, 94%, 96%, 98%, 99%, or 100% sequence identity) to SEQ ID NO:602 and a light chain variable region comprising an amino acid sequence that has at least 90% sequence identity (90%, 92%, 94%, 96%, 98%, 99%, or 100% sequence identity) to SEQ ID NO:616. In some embodiments, the isolated antibody comprises a heavy chain variable region comprising the sequence of SEQ ID NO:602 and a light chain variable region comprising the sequence of SEQ ID NO:616.

In another aspect, the disclosure features an isolated antibody or antigen-binding portion thereof, comprising one or more CDRs selected from the group consisting of: (a) a heavy chain CDR1 comprising the amino acid sequence of SEQ ID NO:586; (b) a heavy chain CDR2 comprising the amino acid sequence of SEQ ID NO:588; (c) a heavy chain CDR3 comprising the amino acid sequence of SEQ ID NO:24; (d) a light chain CDR1 comprising the amino acid sequence of SEQ ID NO:450; (e) a light chain CDR2 comprising the amino acid sequence of SEQ ID NO:27; and (f) a light chain CDR3 comprising the amino acid sequence of SEQ ID NO:461. In some embodiments, the isolated antibody comprises (a) a heavy chain CDR1 comprising the amino acid sequence of SEQ ID NO:586; (b) a heavy chain CDR2 comprising the amino acid sequence of SEQ ID NO:588; (c) a heavy chain CDR3 comprising the amino acid sequence of SEQ ID NO:24; (d) a light chain CDR1 comprising the amino acid sequence of SEQ ID NO:450; (e) a light chain CDR2 comprising the amino acid sequence of SEQ ID NO:27; and (f) a light chain CDR3 comprising the amino acid sequence of SEQ ID NO:461. In some embodiments, the isolated antibody comprises a heavy chain variable region comprising an amino acid sequence that has at least 90% sequence identity (90%, 92%, 94%, 96%, 98%, 99%, or 100% sequence identity) to SEQ ID NO:602 and a light chain variable region comprising an amino acid sequence that has at least 90% sequence identity (90%, 92%, 94%, 96%, 98%, 99%, or 100% sequence identity) to SEQ ID NO:463. In some embodiments, the isolated antibody comprises a heavy chain variable region comprising the sequence of SEQ ID NO:602 and a light chain variable region comprising the sequence of SEQ ID NO:463.

In another aspect, the disclosure features an isolated antibody or antigen-binding portion thereof, comprising one or more CDRs selected from the group consisting of: (a) a heavy chain CDR1 comprising the amino acid sequence of SEQ ID NO:587; (b) a heavy chain CDR2 comprising the amino acid sequence of SEQ ID NO:588; (c) a heavy chain CDR3 comprising the amino acid sequence of SEQ ID NO:24; (d) a light chain CDR1 comprising the amino acid sequence of SEQ ID NO:158; (e) a light chain CDR2 comprising the amino acid sequence of SEQ ID NO:27; and (f) a light chain CDR3 comprising the amino acid sequence of SEQ ID NO:28. In some embodiments, the isolated antibody comprises (a) a heavy chain CDR1 comprising the amino acid sequence of SEQ ID NO:587; (b) a heavy chain CDR2 comprising the amino acid sequence of SEQ ID NO:588; (c) a heavy chain CDR3 comprising the amino acid sequence of SEQ ID NO:24; (d) a light chain CDR1 comprising the amino acid sequence of SEQ ID NO:158; (e) a light chain CDR2 comprising the amino acid sequence of SEQ ID NO:27; and (f) a light chain CDR3 comprising the amino acid sequence of SEQ ID NO:28. In some embodiments, the isolated antibody comprises a heavy chain variable region comprising an amino acid sequence that has at least 90% sequence identity (90%, 92%, 94%, 96%, 98%, 99%, or 100% sequence identity) to SEQ ID NO:603 and a light chain variable region comprising an amino acid sequence that has at least 90% sequence identity (90%, 92%, 94%, 96%, 98%, 99%, or 100% sequence identity) to SEQ ID NO:604. In some embodiments, the isolated antibody comprises a heavy chain variable region comprising the sequence of SEQ ID NO:603 and a light chain variable region comprising the sequence of SEQ ID NO:604.

In another aspect, the disclosure features an isolated antibody or antigen-binding portion thereof, comprising one or more CDRs selected from the group consisting of: (a) a heavy chain CDR1 comprising the amino acid sequence of SEQ ID NO:587; (b) a heavy chain CDR2 comprising the amino acid sequence of SEQ ID NO:588; (c) a heavy chain CDR3 comprising the amino acid sequence of SEQ ID NO:24; (d) a light chain CDR1 comprising the amino acid sequence of SEQ ID NO:158; (e) a light chain CDR2 comprising the amino acid sequence of SEQ ID NO:27; and (f) a light chain CDR3 comprising the amino acid sequence of SEQ ID NO:461. In some embodiments, the isolated antibody comprises (a) a heavy chain CDR1 comprising the amino acid sequence of SEQ ID NO:587; (b) a heavy chain CDR2 comprising the amino acid sequence of SEQ ID NO:588; (c) a heavy chain CDR3 comprising the amino acid sequence of SEQ ID NO:24; (d) a light chain CDR1 comprising the amino acid sequence of SEQ ID NO:158; (e) a light chain CDR2 comprising the amino acid sequence of SEQ ID NO:27; and (f) a light chain CDR3 comprising the amino acid sequence of SEQ ID NO:461. In some embodiments, the isolated antibody comprises a heavy chain variable region comprising an amino acid sequence that has at least 90% sequence identity (90%, 92%, 94%, 96%, 98%, 99%, or 100% sequence identity) to SEQ ID NO:603 and a light chain variable region comprising an amino acid sequence that has at least 90% sequence identity (90%, 92%, 94%, 96%, 98%, 99%, or 100% sequence identity) to SEQ ID NO:616. In some embodiments, the isolated antibody comprises a heavy chain variable region comprising the sequence of SEQ ID NO:603 and a light chain variable region comprising the sequence of SEQ ID NO:616.

In another aspect, the disclosure features an isolated antibody or antigen-binding portion thereof, comprising one or more CDRs selected from the group consisting of: (a) a heavy chain CDR1 comprising the amino acid sequence of SEQ ID NO:587; (b) a heavy chain CDR2 comprising the amino acid sequence of SEQ ID NO:588; (c) a heavy chain CDR3 comprising the amino acid sequence of SEQ ID NO:24; (d) a light chain CDR1 comprising the amino acid sequence of SEQ ID NO:450; (e) a light chain CDR2 comprising the amino acid sequence of SEQ ID NO:27; and (f) a light chain CDR3 comprising the amino acid sequence of SEQ ID NO:461. In some embodiments, the isolated antibody comprises (a) a heavy chain CDR1 comprising the amino acid sequence of SEQ ID NO:587; (b) a heavy chain CDR2 comprising the amino acid sequence of SEQ ID NO:588; (c) a heavy chain CDR3 comprising the amino acid sequence of SEQ ID NO:24; (d) a light chain CDR1 comprising the amino acid sequence of SEQ ID NO:450; (e) a light chain CDR2 comprising the amino acid sequence of SEQ ID NO:27; and (f) a light chain CDR3 comprising the amino acid sequence of SEQ ID NO:461. In some embodiments, the isolated antibody comprises a heavy chain variable region comprising an amino acid sequence that has at least 90% sequence identity (90%, 92%, 94%, 96%, 98%, 99%, or 100% sequence identity) to SEQ ID NO:603 and a light chain variable region comprising an amino acid sequence that has at least 90% sequence identity (90%, 92%, 94%, 96%, 98%, 99%, or 100% sequence identity) to SEQ ID NO:463. In some embodiments, the isolated antibody comprises a heavy chain variable region comprising the sequence of SEQ ID NO:603 and a light chain variable region comprising the sequence of SEQ ID NO:463.

In some embodiments of the previous six aspects, the isolated antibody comprises a modified Fc polypeptide comprising the sequence of any one of SEQ ID NOS:342-353 and 516-522.

In some embodiments of the previous six aspects, the isolated antibody comprises a modified Fc polypeptide comprising the sequence of any one of SEQ ID NOS:354-365 and 523-529.

In some embodiments of the previous six aspects, the isolated antibody comprises a modified Fc polypeptide comprising the sequence of any one of SEQ ID NOS:366-377 and 530-536.

In some embodiments of the previous six aspects, the isolated antibody comprises a modified Fc polypeptide comprising the sequence of any one of SEQ ID NOS:378-389 and 537-543.

In some embodiments of the previous six aspects, the isolated antibody comprises a modified Fc polypeptide comprising the sequence of any one of SEQ ID NOS:390-401 and 544-550.

In some embodiments of the previous six aspects, the isolated antibody comprises a modified Fc polypeptide comprising the sequence of any one of SEQ ID NOS:402-413 and 551-557.

In some embodiments of the previous six aspects, the isolated antibody comprises a modified Fc polypeptide comprising the sequence of any one of SEQ ID NOS:271-278, 476-479, and 558-564.

In some embodiments of the previous six aspects, the isolated antibody comprises a modified Fc polypeptide comprising the sequence of any one of SEQ ID NOS:480-491 and 565-571.

In some embodiments of the previous six aspects, the isolated antibody comprises a modified Fc polypeptide comprising the sequence of any one of SEQ ID NOS:492-503 and 572-578.

In some embodiments of the previous six aspects, the isolated antibody comprises a modified Fc polypeptide comprising the sequence of any one of SEQ ID NOS:504-515 and 579-585.

In some embodiments, the modified Fc polypeptide is fused to a heavy chain variable region of the isolated antibody.

In some embodiments, the modified Fc polypeptide binds to the apical domain of the transferrin receptor. In some embodiments, the binding of the antibody or antigen-binding portion thereof to the transferrin receptor does not substantially inhibit binding of transferrin to the transferrin receptor.

In some embodiments, the modified Fc polypeptide has at least 75%, or at least 80%, 90%, 92%, or 95%, amino acid sequence identity to the corresponding wild-type Fc polypeptide. In some embodiments, the corresponding wild-type Fc polypeptide is a human IgG1, IgG2, IgG3, or IgG4 Fc polypeptide.

In some embodiments, uptake into the brain of the antibody or antigen-binding portion thereof is at least ten-fold greater as compared to the uptake of the antibody or antigen-binding portion thereof without the modified Fc polypeptide that result in transferrin receptor binding.

In some embodiments, the antibody (or antigen-binding portion thereof) specifically binds to the human Tau protein with a binding affinity of less than about 50 nM. In some embodiments, the antibody specifically binds to the human Tau protein with a binding affinity of about 1 pM to about 50 nM. In some embodiments, the antibody specifically binds to the human Tau protein with a binding affinity of about 50 pM to about 50 nM. In some embodiments, the antibody specifically binds to a phosphorylated human Tau protein and/or an unphosphorylated human Tau protein. In some embodiments, the antibody specifically binds to both a phosphorylated human Tau protein and an unphosphorylated human Tau protein. In some embodiments, the antibody specifically binds to two or more splice isoforms of the human Tau protein selected from the group consisting of 2N4R, 2N3R, 1N4R, 1N3R, 0N4R, and 0N3R. In some embodiments, the antibody specifically binds to all of the splice isoforms 2N4R, 2N3R, 1N4R, 1N3R, 0N4R, and 0N3R of the human Tau protein. In some embodiments, the antibody specifically binds to an unphosphorylated form and/or a phosphorylated form for two or more (e.g., 2, 3, 4, 5, or 6) of the splice isoforms 2N4R, 2N3R, 1N4R, 1N3R, 0N4R, and 0N3R. In some embodiments, the antibody specifically binds to both an unphosphorylated form and a phosphorylated form for each of the splice isoforms 2N4R, 2N3R, 1N4R, 1N3R, 0N4R, and 0N3R. In some embodiments, the antibody exhibits cross-reactivity with a cynomolgus monkey Tau protein and/or a mouse Tau protein.

In some embodiments, the antibody (or antigen-binding portion thereof) is a monoclonal antibody. In some embodiments, the antibody is a chimeric antibody. In some embodiments, the antibody is a humanized antibody. In some embodiments, the antibody is a fully human antibody. In some embodiments, the antigen-binding portion is a Fab, a F(ab')$_2$, a scFv, or a bivalent scFv.

In another aspect, antigen-binding fragments that specifically bind to a human Tau protein are provided. In some embodiments, the antigen-binding fragment further comprises an Fc polypeptide. In some embodiments, the Fc polypeptide is a modified Fc polypeptide. In some embodiments, the Fc polypeptide contains one or more of the modifications described herein, e.g., to promote heterodimerization, reduce effector function, extend serum half-life, and/or bind to a transferrin receptor. As a non-limiting example, the antigen-binding fragment may include a Fab fragment that further comprises an Fc polypeptide, e.g., a Fab-Fc fusion. In other embodiments, the antigen-binding fragment further comprises a first Fc polypeptide and a second Fc polypeptide. In some embodiments, the first Fc polypeptide is a modified Fc polypeptide and/or the second Fc polypeptide is a modified Fc polypeptide. In some embodiments, the first Fc polypeptide and/or the second Fc polypeptide contains one or more of the modifications described herein, e.g., to promote heterodimerization, reduce effector function, extend serum half-life, and/or bind to a transferrin receptor. As a non-limiting example, the antigen-binding fragment may include a F(ab')$_2$ fragment that further comprises a first Fc polypeptide and a second Fc polypeptide, e.g., a F(ab')$_2$-Fc fusion.

In another aspect, pharmaceutical compositions are provided. In some embodiments, the pharmaceutical composition comprises an antibody that specifically binds to a human Tau protein as described herein and further comprises one or more pharmaceutically acceptable excipients.

In another aspect, multispecific antibodies (e.g., bispecific antibodies) are provided. In some embodiments, the antibody is a bispecific antibody comprising an antibody that specifically binds to a human Tau protein as described herein.

In yet another aspect, isolated polynucleotides are provided. In some embodiments, the isolated polynucleotide comprises a nucleotide sequence encoding an isolated antibody that specifically binds to a human Tau protein as described herein. In another aspect, vectors and host cells comprising such an isolated polynucleotide are provided.

In yet another aspect, antibodies are provided that compete for specific binding to a human Tau protein with an antibody as described herein.

In still another aspect, methods of preventing, reducing, or inhibiting Tau oligomerization and/or Tau aggregation (e.g., in a subject) are provided. In some embodiments, the method comprises administering to a subject an antibody (or antigen-binding portion) that specifically binds to a human Tau protein as described herein, or a pharmaceutical composition or bispecific antibody comprising an anti-Tau antibody as described herein. In some embodiments, the subject has a neurodegenerative disease such as a tauopathy (e.g., a neurodegenerative tauopathy).

In yet another aspect, methods of preventing or reducing pathological Tau seeding and/or spreading in a brain of a subject are provided. In some embodiments, the method comprises administering to the subject an antibody (or antigen-binding portion) that specifically binds to a human Tau protein as described herein, or a pharmaceutical composition or bispecific antibody comprising an anti-Tau antibody as described herein. In some embodiments, the subject has a neurodegenerative disease such as a tauopathy (e.g., a neurodegenerative tauopathy).

In yet another aspect, methods of treating a neurodegenerative disease are provided. In some embodiments, the neurodegenerative disease is a tauopathy (e.g., a neurodegenerative tauopathy). In some embodiments, the method comprises administering to the subject an antibody (or antigen-binding portion) that specifically binds to a human Tau protein as described herein, or a pharmaceutical composition or bispecific antibody comprising an anti-Tau antibody as described herein.

In some embodiments, the neurodegenerative tauopathy is selected from the group consisting of Alzheimer's disease, primary age-related tauopathy, progressive supranuclear palsy (PSP), frontotemporal dementia, frontotemporal dementia with parkinsonism linked to chromosome 17, argyrophilic grain dementia, amyotrophic lateral sclerosis/parkinsonism-dementia complex of Guam, corticobasal degeneration, chronic traumatic encephalopathy, Creutzfeldt-Jakob disease, dementia pugilistica, diffuse neurofibrillary tangles with calcification, Down's syndrome, familial British dementia, familial Danish dementia, Gerstmann-Straussler-Scheinker disease, globular glial tauopathy, Guadeloupean parkinsonism with dementia, Guadelopean PSP, Hallevorden-Spatz disease, inclusion-body myositis, multiple system atrophy, myotonic dystrophy, neurofibrillary tangle-predominant dementia, Niemann-Pick disease type C, pallido-ponto-nigral degeneration, Parkinson's disease, Pick's disease, postencephalitic parkinsonism, prion protein cerebral amyloid angiopathy, progressive subcortical gliosis, subacute sclerosing panencephalitis, Huntington's disease, and tangle only dementia. In some embodiments, the neurodegenerative tauopathy is Alzheimer's disease.

In another aspect, anti-Tau antibodies for use in a method of preventing, reducing, or inhibiting Tau oligomerization and/or Tau aggregation are provided. In some embodiments, an antibody or antigen-binding portion thereof that specifically binds to a human Tau protein as described herein, or a pharmaceutical composition or bispecific antibody comprising an anti-Tau antibody as described herein, is for use in a method of preventing, reducing, or inhibiting Tau oligomerization. In some embodiments, an antibody or antigen-binding portion thereof that specifically binds to a human Tau protein as described herein, or a pharmaceutical composition or bispecific antibody comprising an anti-Tau antibody as described herein, is for use in a method of preventing, reducing, or inhibiting Tau aggregation.

In yet another aspect, anti-Tau antibodies for use in a method of preventing or reducing pathological Tau seeding and/or spreading (e.g., in a brain of a subject) are provided. In some embodiments, an antibody or antigen-binding portion thereof that specifically binds to a human Tau protein as described herein, or a pharmaceutical composition or bispecific antibody comprising an anti-Tau antibody as described herein, is for use in a method of preventing or reducing pathological Tau seeding and/or spreading.

In still another aspect, anti-Tau antibodies for use in a method of treating a neurodegenerative disease are provided. In some embodiments, the neurodegenerative disease is a tauopathy (e.g., a neurodegenerative tauopathy). In some embodiments, an antibody or antigen-binding portion thereof that specifically binds to a human Tau protein as described herein, or a pharmaceutical composition or bispecific antibody comprising an anti-Tau antibody as described herein, is for use in a method of treating a neurodegenerative disease (e.g., a tauopathy). In some embodiments, an antibody or antigen-binding portion thereof that specifically binds to a human Tau protein as described herein, or a pharmaceutical composition or bispecific antibody comprising an anti-Tau antibody as described herein, is for use in a method of treating a neurodegenerative tauopathy selected from the group consisting of Alzheimer's disease, primary age-related tauopathy, progressive supranuclear palsy (PSP), frontotemporal dementia, frontotemporal dementia with parkinsonism linked to chromosome 17, argyrophilic grain dementia, amyotrophic lateral sclerosis/parkinsonism-dementia complex of Guam, corticobasal degeneration, chronic traumatic encephalopathy, Creutzfeldt-Jakob disease, dementia pugilistica, diffuse neurofibrillary tangles with calcification, Down's syndrome, familial British dementia, familial Danish dementia, Gerstmann-Straussler-Scheinker disease, globular glial tauopathy, Guadeloupean parkinsonism with dementia, Guadelopean PSP, Hallevorden-Spatz disease, inclusion-body myositis, multiple system atrophy, myotonic dystrophy, neurofibrillary tangle-predominant dementia, Niemann-Pick disease type C, pallido-ponto-nigral degeneration, Parkinson's disease, Pick's disease, postencephalitic parkinsonism, prion protein cerebral amyloid angiopathy, progressive subcortical gliosis, subacute sclerosing panencephalitis, Huntington's disease, and tangle only dementia.

In yet another aspect, the use of an anti-Tau antibody as described herein (or an antigen-binding portion thereof as described herein, or a pharmaceutical composition or bispecific antibody comprising an anti-Tau antibody as described herein) in the manufacture of a medicament for the prevention, reduction, or inhibition of Tau oligomerization and/or for the prevention, reduction, or inhibition of Tau aggregation is provided.

In still another aspect, the use of an anti-Tau antibody as described herein (or an antigen-binding portion thereof as described herein, or a pharmaceutical composition or bispecific antibody comprising an anti-Tau antibody as described herein) in the manufacture of a medicament for the prevention or reduction of pathological Tau seeding and/or spreading (e.g., in a brain of a subject) is provided.

In yet another aspect, the use of an anti-Tau antibody as described herein (or an antigen-binding portion thereof as described herein, or a pharmaceutical composition or bispecific antibody comprising an anti-Tau antibody as described herein) in the manufacture of a medicament for the treatment of a neurodegenerative disease (e.g., a tauopathy) is provided. In some embodiments, the use of an anti-Tau antibody as described herein is for the manufacture of a medicament for the treatment of a tauopathy selected from the group consisting of Alzheimer's disease, primary age-related tauopathy, progressive supranuclear palsy (PSP), frontotemporal dementia, frontotemporal dementia with parkinsonism linked to chromosome 17, argyrophilic grain dementia, amyotrophic lateral sclerosis/parkinsonism-dementia complex of Guam, corticobasal degeneration, chronic traumatic encephalopathy, Creutzfeldt-Jakob disease, dementia pugilistica, diffuse neurofibrillary tangles with calcification, Down's syndrome, familial British dementia, familial Danish dementia, Gerstmann-Straussler-Scheinker disease, globular glial tauopathy, Guadeloupean parkinsonism with dementia, Guadelopean PSP, Hallevorden-Spatz disease, inclusion-body myositis, multiple system atrophy, myotonic dystrophy, neurofibrillary tangle-predominant dementia, Niemann-Pick disease type C, pallido-ponto-nigral degeneration, Parkinson's disease, Pick's disease, postencephalitic parkinsonism, prion protein cerebral amyloid angiopathy, progressive subcortical gliosis, subacute sclerosing panencephalitis, Huntington's disease, and tangle only dementia.

BRIEF DESCRIPTION OF THE DRAWINGS

FIGS. 2A-2D. Production of Tau antigen. (A) Amino acid sequence of Tau produced in *E. coli*, including the His6-Smt3 tag (SEQ ID NO:3). (B) SDS-PAGE gel of the original uncleaved Tau and Tau product cleaved with ubiquitin-like-specific protease 1 (Ulp1) to remove the tag. (C) SDS-PAGE gel of the final purified un-tagged recombinant Tau (r-Tau) antigen ("Tau-441"). (D) Western blots showing phosphorylation of r-Tau. HT7 is a commercially available anti-Tau antibody included as a control for total Tau.

FIG. 3. Sequence alignment of clone 1C7 (SEQ ID NO:25: 1C7 VL; SEQ ID NO:21: 1C7 VH) with human immunoglobulin kappa variable 4 (IGKV4) (light chain) (SEQ ID NO:637) and immunoglobulin heavy variable 3 (IGHV3) (heavy chain) (SEQ ID NO:640) sequences. Kabat numbers that are shaded represent Vernier positions that make critical contacts within the antibody to support its interaction with the antigen. In the 1C7 sequence, amino acids that are shaded represent positions that differ with respect to the corresponding IGKV4 or IGHV3 sequences.

FIGS. 10A and 10B. Epitopes of selected chimeric IgG clones. (A) Clone 1C7 recognizes an epitope within amino acids 111-125 of human Tau 2N4R (SEQ ID NO:1). (B) Clone 1A1 recognizes an epitope within amino acids 251-270 of human Tau 2N4R (SEQ ID NO:1), with the strongest binding within amino acids 256-270 (underlined), and also recognizes an epitope within amino acids 346-360 of human Tau 2N4R (SEQ ID NO:1).

FIGS. 26A and 26B. In vivo pharmacokinetic analysis (plasma concentrations (FIG. 26A) and clearance values (FIG. 26B)) for various anti-Tau clones.

DETAILED DESCRIPTION OF THE INVENTION

I. Introduction

Figure 1:
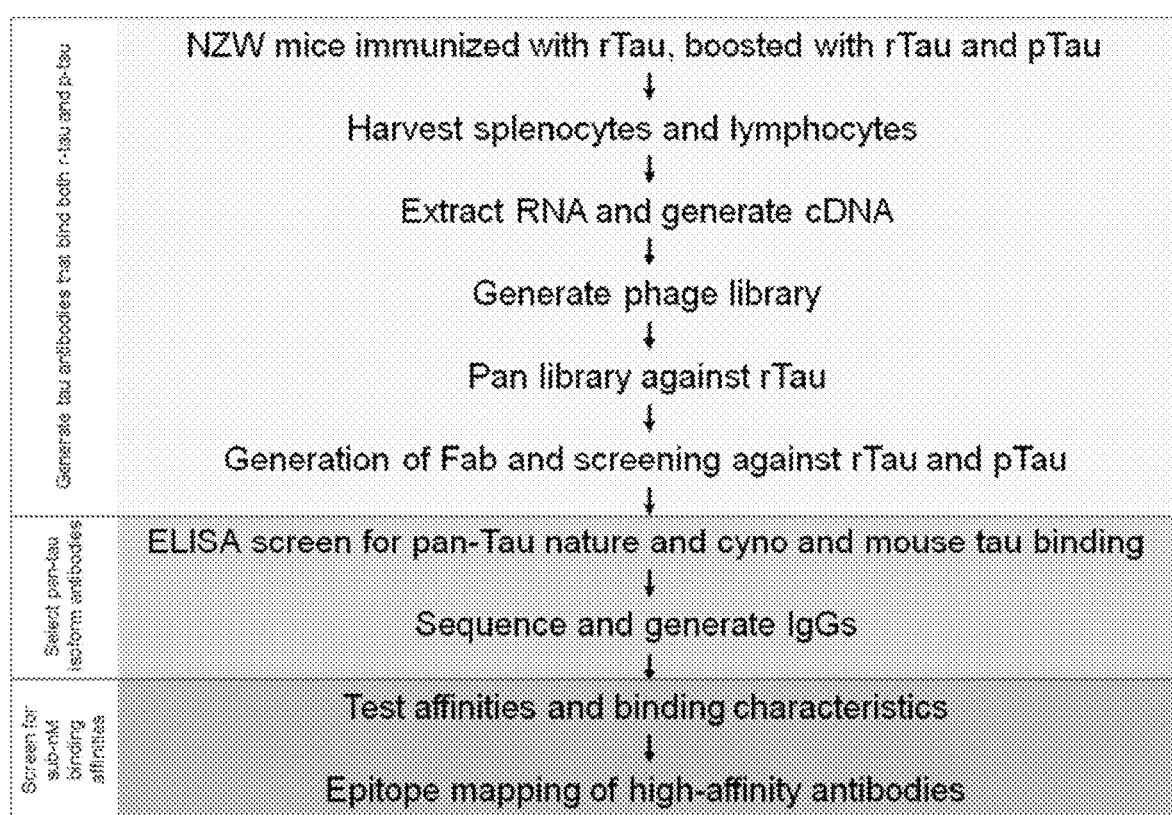
FIG. 1. Workflow of anti-Tau antibody discovery using phage-display technology.

The present invention relates to the discovery of antibodies that have the ability to specifically bind to Tau protein. In one aspect, antibodies having the ability to specifically bind to both phosphorylated Tau protein and unphosphorylated Tau protein are provided. In some embodiments, the anti-Tau antibodies described herein specifically bind to multiple isoforms of human Tau (2N4R, 2N3R, 1N4R, 1N3R, 0N4R, and/or 0N3R). In some embodiments, the anti-Tau antibodies also exhibit cross-reactivity to mouse Tau and/or cynomolgus monkey Tau.

In some embodiments, the anti-Tau antibody recognizes more than one epitope of Tau protein. In some embodiments, the anti-Tau antibody is fused to a modified Fc polypeptide that specifically binds to a transferrin receptor. In some embodiments, the anti-Tau antibody comprises one or more modifications that promote heterodimerization, reduce effector function, and/or increase serum-half-life. In some embodiments, the anti-Tau antibody comprises a native FcRn binding site. In some embodiments, the anti-Tau antibody is a dual epitope antibody. As described below in the Examples section, anti-Tau antibodies have been identified that recognize two distinct epitopes within full-length Tau. Tau is a phosphoprotein, and phosphorylation of Tau can affect the ability of an antibody to bind to an epitope that the antibody recognizes in an unphosphorylated state. Thus, for binding to a phosphorylated form of Tau in which an epitope contains a phosphorylation site, dual epitope antibodies provide the advantage of being able to recognize a second binding site in the event that one binding site in the Tau antigen has been phosphorylated. Additionally, as described below, anti-Tau antibodies have been identified that recognize a Tau epitope both in its unphosphorylated form and its phosphorylated form.

The anti-Tau antibodies described herein are useful for, as non-limiting examples, preventing, reducing, or inhibiting pathological Tau seeding, spreading, oligomerization, and/or aggregation. Accordingly, antibodies of the present invention are useful for preventing or treating neurodegenerative diseases such as a tauopathy (e.g., Alzheimer's disease).

II. Definitions

As used herein, the singular forms "a", "an" and "the" include plural referents unless the content clearly dictates otherwise. Thus, for example, reference to "an antibody" optionally includes a combination of two or more such molecules, and the like.

As used herein, the terms "about" and "approximately," when used to modify an amount specified in a numeric value or range indicate that the numeric value as well as reasonable deviations from the value known to the skilled person in the art, for example ±20%, ±10%, or ±5%, are within the intended meaning of the recited value.

As used herein, the term "Tau protein" refers to a native (i.e., wild-type) Tau protein from any vertebrate source, such as but not limited to human, non-human primates (e.g., cynomolgus monkey), rodents (e.g., mice), and other mammals. As used herein, the term "Tau protein" encompasses a "full-length" Tau protein having a length of 441 amino acids (SEQ ID NO:1) as well as other naturally occurring isoforms of Tau. It will be recognized by a person of ordinary skill in the art that in humans, there are six isoforms of Tau that result from alternative splicing of the gene encoding Tau (microtubule-associated protein, MAPT): 2N4R, having a length of 441 amino acids (SEQ ID NO:1); 1N4R, having a length of 412 amino acids (SEQ ID NO:56); 2N3R, having a length of 410 amino acids (SEQ ID NO:54); 0N4R, having a length of 383 amino acids (SEQ ID NO:55); 1N3R, having a length of 381 amino acids (SEQ ID NO:53); and 0N3R, having a length of 352 amino acids (SEQ ID NO:52).

As used herein, the terms "an antibody that specifically binds to a Tau protein" and "anti-Tau antibody" interchangeably refer to an antibody that specifically binds to a Tau protein (e.g., unphosphorylated Tau, phosphorylated Tau, total Tau (phosphorylated and unphosphorylated Tau), or a Tau splice isoform). In some embodiments, an anti-Tau antibody is an antibody that specifically binds to multiple forms of Tau protein (e.g., multiple Tau splice isoforms, unphosphorylated Tau, and/or phosphorylated Tau). In some embodiments, an anti-Tau antibody is an antibody that specifically binds to all six human Tau splice isoforms and to unphosphorylated Tau.

As used herein, the term "antibody" refers to a protein functionally defined as a binding protein and structurally defined as comprising an amino acid sequence that is recognized by one of skill as being derived from a variable region of an immunoglobulin encoding gene. The term encompasses intact polyclonal antibodies, intact monoclonal antibodies, single chain antibodies, multispecific antibodies such as bispecific antibodies, monospecific antibodies, monovalent antibodies, chimeric antibodies, humanized antibodies, and human antibodies. The term "antibody," as used herein, also includes antibody fragments that retain binding specificity, including but not limited to Fab, F(ab')$_2$, Fv, scFv, and bivalent scFv. An antibody can consist of one or more polypeptides substantially encoded by immunoglobulin genes or fragments of immunoglobulin genes. The recognized immunoglobulin genes include the kappa, lambda, alpha, gamma, delta, epsilon, and mu constant region genes, as well as myriad immunoglobulin variable region genes. Light chains are classified as either kappa or lambda. Heavy chains are classified as gamma, mu, alpha, delta, or epsilon, which in turn define the immunoglobulin classes, IgG, IgM, IgA, IgD and IgE, respectively.

An exemplary immunoglobulin (antibody) structural unit comprises a tetramer. Each tetramer is composed of two identical pairs of polypeptide chains, each pair having one "light" (about 25 kD) and one "heavy" chain (about 50-70 kD). The N-terminus of each chain defines a variable region of about 100 to 110 or more amino acids primarily responsible for antigen recognition. The terms "variable light chain" (VL) and "variable heavy chain" (VH) refer to these light and heavy chains, respectively.

The term "variable region" refers to a domain in an antibody heavy chain or light chain that derived from a germline Variable (V) gene, Diversity (D) gene, or Joining (J) gene (and not derived from a Constant (Cμ and Cδ) gene segment), and that gives an antibody its specificity for binding to an antigen. Typically, an antibody variable region comprises four conserved "framework" regions interspersed with three hypervariable "complementarity determining" regions."

The term "complementarity determining region" or "CDR" refers to the three hypervariable regions in each chain that interrupt the four framework regions established by the light and heavy chain variable regions. The CDRs are primarily responsible for antibody binding to an epitope of an antigen. The CDRs of each chain are typically referred to as CDR1, CDR2, and CDR3, numbered sequentially starting from the N-terminus, and are also typically identified by the chain in which the particular CDR is located. Thus, a VH CDR3 or CDR-H3 is located in the variable region of the heavy chain of the antibody in which it is found, whereas a VL CDR1 or CDR-L1 is the CDR1 from the variable region of the light chain of the antibody in which it is found.

The "framework regions" or "FRs" of different light or heavy chains are relatively conserved within a species. The framework region of an antibody, that is the combined framework regions of the constituent light and heavy chains, serves to position and align the CDRs in three-dimensional space. Framework sequences can be obtained from public DNA databases or published references that include germline antibody gene sequences. For example, germline DNA sequences for human heavy and light chain variable region genes can be found in the "VBASE2" germline variable gene sequence database for human and mouse sequences.

The amino acid sequences of the CDRs and framework regions can be determined using various well-known definitions in the art, e.g., Kabat, Chothia, international ImMunoGeneTics database (IMGT), AbM, and observed antigen contacts ("Contact"). In some embodiments, CDRs are determined according to the Contact definition. See, MacCallum et al., *J. Mol. Biol.*, 262:732-745 (1996). In some embodiments, CDRs are determined by a combination of Kabat, Chothia, and Contact CDR definitions.

The terms "antigen-binding portion" and "antigen-binding fragment" are used interchangeably herein and refer to one or more fragments of a molecule, e.g., an antibody, that retains the ability to specifically bind to an antigen (e.g., a Tau protein). Examples of antigen-binding fragments include, but are not limited to, a Fab fragment (a monovalent fragment consisting of the VL, VH, CL and CH1 domains), F(ab')$_2$ fragment (a bivalent fragment comprising two Fab fragments linked by a disulfide bridge at the hinge region), single chain Fv (scFv), disulfide-linked Fv (dsFv), complementarity determining regions (CDRs), a VL (light chain variable region), a VH (heavy chain variable region), nanobodies, diabodies, each of which bind the antigen via a variable region, and other formats as described in Spiess et al., *Mol. Immun.* 67 (2015) 95-106, which is incorporated herein by reference, and any combination of these or any other functional portion of an immunoglobulin peptide capable of binding to a target antigen.

The term "epitope" refers to the area or region of an antigen to which a molecule, e.g., the CDRs of an antibody, specifically binds and can include a few amino acids or portions of a few amino acids, e.g., 5 or 6, or more, e.g., 20 or more amino acids, or portions of those amino acids. In some cases, the epitope includes non-protein components, e.g., from a carbohydrate, nucleic acid, or lipid. In some cases, the epitope is a three-dimensional moiety. Thus, for example, where the target is a protein, the epitope can be comprised of consecutive amino acids (e.g., a linear epitope), or amino acids from different parts of the protein that are brought into proximity by protein folding (e.g., a discontinuous or conformational epitope). In some embodiments, an antibody specifically binds to two distinct regions of an antigen (e.g., a Tau protein) that are not brought into proximity by protein folding, referred to herein as a "dual epitope." In some embodiments, the epitope is phosphorylated at one amino acid (e.g., at a serine or threonine residue).

As used herein, the phrase "recognizes an epitope," as used with reference to an anti-Tau antibody, means that the antibody CDRs interact with or specifically bind to the antigen (i.e., the Tau protein) at that epitope or a portion of the antigen containing that epitope.

As used herein, the term "multispecific antibody" refers to an antibody that comprises two or more different antigen-binding portions, in which each antigen-binding portion comprises a different variable region that recognizes a different antigen, or a fragment or portion of the antibody that binds to the two or more different antigens. As used herein, the term "bispecific antibody" refers to an antibody that comprises two different antigen-binding portions, in which each antigen-binding portion comprises a different variable region that recognizes a different antigen, or a fragment or portion of the antibody that binds to the two different antigens. In some embodiments, a bispecific antibody comprises a first antigen-binding portion comprising a first variable region that recognizes a Tau antigen and a second antigen-binding portion comprising a second variable region that recognizes an antigen other than Tau.

A "monoclonal antibody" refers to antibodies produced by a single clone of cells or a single cell line and consisting of or consisting essentially of antibody molecules that are identical in their primary amino acid sequence.

A "polyclonal antibody" refers to a pool of antibodies obtained from a heterogeneous population of antibodies in which different antibodies in the population bind to different epitopes of an antigen.

A "chimeric antibody" refers to an antibody molecule in which the constant region, or a portion thereof, is altered, replaced or exchanged so that the antigen-binding site (i.e., variable region, CDR, or portion thereof) is linked to a constant region of a different or altered class, effector function and/or species, or in which the variable region, or a portion thereof, is altered, replaced or exchanged with a variable region having a different or altered antigen specificity (e.g., CDR and framework regions from different species). In some embodiments, a chimeric antibody is a monoclonal antibody comprising a variable region from one source or species (e.g., mouse) and a constant region derived from a second source or species (e.g., human). Methods for producing chimeric antibodies are described in the art.

A "humanized antibody" is an antibody that retains the reactivity of a non-human antibody while being less immunogenic in humans. This can be achieved, for instance, by retaining the non-human CDR regions and replacing the remaining parts of the antibody with their human counterparts. In some instances, it is necessary to retain particular non-human framework residues in order to retain the binding affinity and/or specificity of the non-human antibody once humanized.

A "human antibody" or a "fully human antibody" is an antibody having human heavy chain and light chain sequences, typically derived from human germline genes. In some embodiments, the antibody is produced by a human cell, by a non-human animal that utilizes human antibody repertoires (e.g., transgenic mice that are genetically engineered to express human antibody sequences), or by phage display platforms.

The term "specifically binds" refers to a molecule (e.g., an antibody (or an antigen-binding portion thereof) or a modified Fc polypeptide (or a target-binding portion thereof)) that binds to an epitope or target with greater affinity, greater avidity, and/or greater duration to that epitope or target in a sample than it binds to another epitope or non-target compound (e.g., a structurally different antigen). In some embodiments, an antibody (or an antigen-binding portion thereof) or a modified Fc polypeptide (or a target-binding portion thereof) that specifically binds to an epitope or target is an antibody (or an antigen-binding portion thereof) or a modified Fc polypeptide (or a target-binding portion thereof) that binds to the epitope or target with at least 5-fold greater affinity than other epitopes or non-target compounds, e.g., at least 6-fold, 7-fold, 8-fold, 9-fold, 10-fold, 20-fold, 25-fold, 50-fold, or 100-fold greater affinity. In some embodiments, an antibody that specifically binds to a Tau protein binds to the Tau protein with at least a 5-fold greater affinity than to a non-Tau protein (e.g., at least 6-fold, at least 7-fold, at least 8-fold, at least 9-fold, or at least 10-fold greater affinity). It will be recognized by one of skill that an antibody that specifically binds to a target (e.g., a Tau protein) from one species may also specifically bind to orthologs of that target (e.g., a Tau protein).

The term "binding affinity" is used herein to refer to the strength of a non-covalent interaction between two molecules, e.g., between an antibody (or an antigen-binding portion thereof) and an antigen, or between a modified Fc polypeptide (or a target-binding portion thereof) and a target. Thus, for example, the term may refer to 1:1 interactions between an antibody (or an antigen-binding portion thereof) and an antigen or between a modified Fc polypeptide (or a target-binding portion thereof) and a target, unless otherwise indicated or clear from context. Binding affinity may be quantified by measuring an equilibrium dissociation constant ($K_D$), which refers to the dissociation rate constant ($k_d$, time$^{-1}$) divided by the association rate constant ($k_a$, time$^{-1}$ M$^{-1}$). $K_D$ can be determined by measurement of the kinetics of complex formation and dissociation, e.g., using Surface Plasmon Resonance (SPR) methods, e.g., a Biacore™ system; kinetic exclusion assays such as KinExA®; and BioLayer interferometry (e.g., using the ForteBio® Octet platform). As used herein, "binding affinity" includes not only formal binding affinities, such as those reflecting 1:1 interactions between an antibody (or an antigen-binding portion thereof) and an antigen or between a modified Fc polypeptide (or a target-binding portion thereof) and a target, but also apparent affinities for which $K_D$'s are calculated that may reflect avid binding.

The term "transferrin receptor" or "TfR" as used in the context of this invention refers to transferrin receptor protein 1. The human transferrin receptor 1 polypeptide sequence is set forth in SEQ ID NO:288. Transferrin receptor protein 1 sequences from other species are also known (e.g., chimpanzee, accession number XP_003310238.1; rhesus monkey, NP_001244232.1; dog, NP_001003111.1; cattle, NP_001193506.1; mouse, NP_035768.1; rat, NP_073203.1; and chicken, NP_990587.1). The term "transferrin receptor" also encompasses allelic variants of exemplary reference sequences, e.g., human sequences, that are encoded by a gene at a transferrin receptor protein 1 chromosomal locus. Full-length transferrin receptor protein includes a short N-terminal intracellular region, a transmembrane region, and a large extracellular domain. The extracellular domain is characterized by three domains: a protease-like domain, a helical domain, and an apical domain.

As used herein, the term "Fc polypeptide" refers to the C-terminal region of a naturally occurring immunoglobulin heavy chain polypeptide that is characterized by an Ig fold as a structural domain. An Fc polypeptide contains constant region sequences including at least the CH2 domain and/or the CH3 domain and may contain at least part of the hinge region, but does not contain a variable region.

A "modified Fc polypeptide" refers to an Fc polypeptide that has at least one mutation, e.g., a substitution, deletion or insertion, as compared to a wild-type immunoglobulin heavy chain Fc polypeptide sequence, but retains the overall Ig fold or structure of the native Fc polypeptide.

The term "FcRn" refers to the neonatal Fc receptor. Binding of Fc polypeptides to FcRn reduces clearance and increases serum half-life of the Fc polypeptide. The human FcRn protein is a heterodimer that is composed of a protein of about 50 kDa in size that is similar to a major histocompatibility (MHC) class I protein and a β2-microglobulin of about 15 kDa in size.

As used herein, an "FcRn binding site" refers to the region of an Fc polypeptide that binds to FcRn. In human IgG, the FcRn binding site, as numbered using the EU index, includes L251, M252, I253, S254, R255, T256, M428, H433, N434, H435, and Y436. These positions correspond to positions 21 to 26, 198, and 203 to 206 of SEQ ID NO:181.

As used herein, a "native FcRn binding site" refers to a region of an Fc polypeptide that binds to FcRn and that has the same amino acid sequence as the region of a naturally occurring Fc polypeptide that binds to FcRn.

The terms "CH3 domain" and "CH2 domain" as used herein refer to immunoglobulin constant region domain polypeptides. For purposes of this application, a CH3 domain polypeptide refers to the segment of amino acids from about position 341 to about position 447 as numbered according to the EU numbering scheme, and a CH2 domain polypeptide refers to the segment of amino acids from about position 231 to about position 340 as numbered according to the EU numbering scheme and does not include hinge region sequences. CH2 and CH3 domain polypeptides may also be numbered by the IMGT (ImMunoGeneTics) numbering scheme in which the CH2 domain numbering is 1-110 and the CH3 domain numbering is 1-107, according to the IMGT Scientific chart numbering (IMGT website). CH2 and CH3 domains are part of the Fc region of an immunoglobulin. An Fc region refers to the segment of amino acids from about position 231 to about position 447 as numbered according to the EU numbering scheme, but as used herein, can include at least a part of a hinge region of an antibody. An illustrative hinge region sequence is the human IgG1 hinge sequence EPKSCDKTHTCPPCP (SEQ ID NO:287).

The terms "wild-type," "native," and "naturally occurring" with respect to a CH3 or CH2 domain are used herein to refer to a domain that has a sequence that occurs in nature.

In the context of this invention, the term "mutant" with respect to a mutant polypeptide or mutant polynucleotide is used interchangeably with "variant." A variant with respect to a given wild-type CH3 or CH2 domain reference sequence can include naturally occurring allelic variants. A "non-naturally" occurring CH3 or CH2 domain refers to a variant or mutant domain that is not present in a cell in nature and that is produced by genetic modification, e.g., using genetic engineering technology or mutagenesis techniques, of a native CH3 domain or CH2 domain polynucleotide or polypeptide. A "variant" includes any domain comprising at least one amino acid mutation with respect to wild-type. Mutations may include substitutions, insertions, and deletions.

The term "cross-reacts," as used herein, refers to the ability of an antibody variable region to bind to an antigen other than the antigen against which the antibody was raised. In some embodiments, cross-reactivity refers to the ability of an antibody variable region to bind to an antigen from another species than the antigen against which the antibody was raised. As a non-limiting example, an anti-Tau antibody as described herein that is raised against a human Tau protein can exhibit cross-reactivity with a Tau protein from a different species (e.g., mouse or monkey).

The term "isolated," as used with reference to a nucleic acid or protein (e.g., antibody), denotes that the nucleic acid or protein is essentially free of other cellular components with which it is associated in the natural state. It is preferably in a homogeneous state. Purity and homogeneity are typically determined using analytical chemistry techniques such as electrophoresis (e.g., polyacrylamide gel electrophoresis) or chromatography (e.g., high performance liquid chromatography). In some embodiments, an isolated nucleic acid or protein (e.g., antibody) is at least 85% pure, at least 90% pure, at least 95% pure, or at least 99% pure.

The term "amino acid" refers to naturally occurring and synthetic amino acids, as well as amino acid analogs and amino acid mimetics that function in a manner similar to the naturally occurring amino acids.

Naturally occurring amino acids are those encoded by the genetic code, as well as those amino acids that are later modified, e.g., hydroxyproline, γ-carboxyglutamate, and O-phosphoserine. "Amino acid analogs" refers to compounds that have the same basic chemical structure as a naturally occurring amino acid, i.e., an α carbon that is bound to a hydrogen, a carboxyl group, an amino group, and an R group, e.g., homoserine, norleucine, methionine sulfoxide, methionine methyl sulfonium. Such analogs have modified R groups (e.g., norleucine) or modified peptide backbones, but retain the same basic chemical structure as a naturally occurring amino acid. "Amino acid mimetics" refers to chemical compounds that have a structure that is different from the general chemical structure of an amino acid, but that functions in a manner similar to a naturally occurring amino acid. Amino acids may be referred to herein by either their commonly known three letter symbols or by the one-letter symbols recommended by the IUPAC-IUB Biochemical Nomenclature Commission.

Naturally occurring amino acids are those encoded by the genetic code, as well as those amino acids that are later modified, e.g., hydroxyproline, γ-carboxyglutamate and O-phosphoserine. Naturally occurring α-amino acids include, without limitation, alanine (Ala), cysteine (Cys), aspartic acid (Asp), glutamic acid (Glu), phenylalanine (Phe), glycine (Gly), histidine (His), isoleucine (Ile), arginine (Arg), lysine (Lys), leucine (Leu), methionine (Met), asparagine (Asn), proline (Pro), glutamine (Gln), serine (Ser), threonine (Thr), valine (Val), tryptophan (Trp), tyrosine (Tyr), and combinations thereof. Stereoisomers of a naturally occurring α-amino acids include, without limitation, D-alanine (D-Ala), D-cysteine (D-Cys), D-aspartic acid (D-Asp), D-glutamic acid (D-Glu), D-phenylalanine (D-Phe), D-histidine (D-His), D-isoleucine (D-Ile), D-arginine (D-Arg), D-lysine (D-Lys), D-leucine (D-Leu), D-methionine (D-Met), D-asparagine (D-Asn), D-proline (D-Pro), D-glutamine (D-Gln), D-serine (D-Ser), D-threonine (D-Thr), D-valine (D-Val), D-tryptophan (D-Trp), D-tyrosine (D-Tyr), and combinations thereof.

The terms "polypeptide" and "peptide" are used interchangeably herein to refer to a polymer of amino acid residues in a single chain. The terms apply to amino acid polymers in which one or more amino acid residue is an artificial chemical mimetic of a corresponding naturally occurring amino acid, as well as to naturally occurring amino acid polymers and non-naturally occurring amino acid polymers. Amino acid polymers may comprise entirely L-amino acids, entirely D-amino acids, or a mixture of L and D amino acids.

The term "protein" as used herein refers to either a polypeptide or a dimer (i.e, two) or multimer (i.e., three or more) of single chain polypeptides. The single chain polypeptides of a protein may be joined by a covalent bond, e.g., a disulfide bond, or non-covalent interactions.

The terms "polynucleotide" and "nucleic acid" interchangeably refer to chains of nucleotides of any length, and include DNA and RNA. The nucleotides can be deoxyribonucleotides, ribonucleotides, modified nucleotides or bases, and/or their analogs, or any substrate that can be incorporated into a chain by DNA or RNA polymerase. A polynucleotide may comprise modified nucleotides, such as methylated nucleotides and their analogs. Examples of polynucleotides contemplated herein include single- and double-stranded DNA, single- and double-stranded RNA, and hybrid molecules having mixtures of single- and double-stranded DNA and RNA.

The term "conservative substitution" or "conservative mutation" refers to an alteration that results in the substitution of an amino acid with another amino acid that can be categorized as having a similar feature. Examples of categories of conservative amino acid groups defined in this manner can include: a "charged/polar group" including Glu (Glutamic acid or E), Asp (Aspartic acid or D), Asn (Asparagine or N), Gln (Glutamine or Q), Lys (Lysine or K), Arg (Arginine or R), and His (Histidine or H); an "aromatic group" including Phe (Phenylalanine or F), Tyr (Tyrosine or Y), Trp (Tryptophan or W), and (Histidine or H); and an "aliphatic group" including Gly (Glycine or G), Ala (Alanine or A), Val (Valine or V), Leu (Leucine or L), Ile (Isoleucine or I), Met (Methionine or M), Ser (Serine or S), Thr (Threonine or T), and Cys (Cysteine or C). Within each group, subgroups can also be identified. For example, the group of charged or polar amino acids can be sub-divided into sub-groups including: a "positively-charged sub-group" comprising Lys, Arg and His; a "negatively-charged sub-group" comprising Glu and Asp; and a "polar sub-group" comprising Asn and Gln. In another example, the aromatic or cyclic group can be sub-divided into sub-groups including: a "nitrogen ring sub-group" comprising Pro, His and Trp; and a "phenyl sub-group" comprising Phe and Tyr. In another further example, the aliphatic group can be sub-divided into sub-groups, e.g., an "aliphatic non-polar sub-group" comprising Val, Leu, Gly, and Ala; and an "aliphatic slightly-polar sub-group" comprising Met, Ser, Thr, and Cys. Examples of categories of conservative mutations include amino acid substitutions of amino acids within the sub-groups above, such as, but not limited to: Lys for Arg or vice versa, such that a positive charge can be maintained; Glu for Asp or vice versa, such that a negative charge can be maintained; Ser for Thr or vice versa, such that a free —OH can be maintained; and Gln for Asn or vice versa, such that a free —NH$_2$ can be maintained. In some embodiments, hydrophobic amino acids are substituted for naturally occurring hydrophobic amino acid, e.g., in the active site, to preserve hydrophobicity.

The terms "identical" or percent "identity," in the context of two or more polypeptide sequences, refer to two or more sequences or subsequences that are the same or have a specified percentage of amino acid residues, e.g., at least 60% identity, at least 65%, at least 70%, at least 75%, at least 80%, at least 85%, at least 90%, or at least 95% or greater, that are identical over a specified region when compared and aligned for maximum correspondence over a comparison window, or designated region as measured using one a sequence comparison algorithm or by manual alignment and visual inspection.

For sequence comparison of polypeptides, typically one amino acid sequence acts as a reference sequence, to which a candidate sequence is compared. Alignment can be performed using various methods available to one of skill in the art, e.g., visual alignment or using publicly available software using known algorithms to achieve maximal alignment. Such programs include the BLAST programs, ALIGN, ALIGN-2 (Genentech, South San Francisco, Calif.) or Megalign (DNASTAR). The parameters employed for an alignment to achieve maximal alignment can be determined by one of skill in the art. For sequence comparison of polypeptide sequences for purposes of this application, the BLASTP algorithm standard protein BLAST for aligning two proteins sequence with the default parameters is used.

The terms "corresponding to," "determined with reference to," or "numbered with reference to" when used in the context of the identification of a given amino acid residue in a polypeptide sequence, refers to the position of the residue of a specified reference sequence when the given amino acid sequence is maximally aligned and compared to the reference sequence. Thus, for example, an amino acid residue in a modified Fc polypeptide "corresponds to" an amino acid in SEQ ID NO:181, when the residue aligns with the amino acid in SEQ ID NO:181 when optimally aligned to SEQ ID NO:181. The polypeptide that is aligned to the reference sequence need not be the same length as the reference sequence.

The terms "subject," "individual," and "patient," as used interchangeably herein, refer to a mammal, including but not limited to humans, non-human primates, rodents (e.g., rats, mice, and guinea pigs), rabbits, cows, pigs, horses, and other mammalian species. In one embodiment, the subject, individual, or patient is a human.

The terms "treat" and "treatment" and the like are used herein to generally mean obtaining a desired pharmacologic and/or physiologic effect. "Treating" or "treatment" may refer to any indicia of success in the treatment or amelioration of a neurodegenerative disease (e.g., Alzheimer's disease or another neurodegenerative disease described herein), including any objective or subjective parameter such as abatement, remission, improvement in patient survival, increase in survival time or rate, diminishing of symptoms or making the disease more tolerable to the patient, slowing in the rate of degeneration or decline, or improving a patient's physical or mental well-being. The treatment or amelioration of symptoms can be based on objective or subjective parameters. The effect of treatment can be compared to an individual or pool of individuals not receiving the treatment, or to the same patient prior to treatment or at a different time during treatment.

The term "pharmaceutically acceptable excipient" refers to a non-active pharmaceutical ingredient that is biologically or pharmacologically compatible for use in humans or animals, such as, but not limited to a buffer, carrier, or preservative.

As used herein, a "therapeutic amount" or "therapeutically effective amount" of an agent (e.g., an antibody as described herein) is an amount of the agent that treats, alleviates, abates, or reduces the severity of symptoms of a disease in a subject. A "therapeutic amount" or "therapeutically effective amount" of an agent (e.g., an antibody as described herein) may improve patient survival, increase survival time or rate, diminish symptoms, make an injury, disease, or condition (e.g., a tauopathy) more tolerable, slow the rate of degeneration or decline, or improve a patient's physical or mental well-being.

The term "administer" refers to a method of delivering agents, compounds, or compositions to the desired site of biological action. These methods include, but are not limited to, topical delivery, parenteral delivery, intravenous delivery, intradermal delivery, intramuscular delivery, intrathecal delivery, colonic delivery, rectal delivery, or intraperitoneal delivery. In one embodiment, an antibody as described herein is administered intravenously.

III. Anti-Tau Antibodies

In one aspect, antibodies and antigen-binding portions of antibodies that specifically bind to a Tau protein (e.g., human Tau) are provided. In some embodiments, the antibody or antigen-binding portion thereof specifically binds to unphosphorylated Tau. In some embodiments, the antibody or antigen-binding portion thereof specifically binds to phosphorylated Tau. In some embodiments, a phosphorylated Tau includes 1, 2, 3, 4, 5, or more phosphorylated serine and/or threonine residues. In some embodiments, the antibody or antigen-binding portion thereof specifically binds to both unphosphorylated Tau and phosphorylated Tau. In some embodiments, the antibody or antigen-binding portion specifically binds to monomeric Tau. In some embodiments, the antibody or antigen-binding portion specifically binds to oligomeric Tau. In some embodiments, the antibody or antigen-binding portion specifically binds to intracellular Tau. In some embodiments, the antibody or antigen-binding portion specifically binds to extracellular Tau.

In some embodiments, the antibody specifically binds to one or more splice isoforms of human Tau protein (i.e., one or more of the splice isoforms 2N4R, 2N3R, 1N4R, 1N3R, 0N4R, and 0N3R). In some embodiments, the antibody specifically binds to two or more splice isoforms of human Tau protein, e.g., to two, three, four, five, or all six of 2N4R, 2N3R, 1N4R, 1N3R, 0N4R, and 0N3R. In some embodiments, the antibody specifically binds to an unphosphorylated form and/or a phosphorylated form of two or more splice isoforms of human Tau protein, e.g., to two, three, four, five, or all six of 2N4R, 2N3R, 1N4R, 1N3R, 0N4R, and 0N3R. In some embodiments, the antibody specifically binds to both an unphosphorylated form and a phosphorylated form of one, two, three, four, five, or all six of the splice isoforms 2N4R, 2N3R, 1N4R, 1N3R, 0N4R, and 0N3R.

Binding Characteristics of Anti-Tau Antibodies

In some embodiments, an anti-Tau antibody specifically binds to full-length human Tau (SEQ ID NO:1) with high affinity. In some embodiments, the antibody has a binding affinity ($K_D$) for SEQ ID NO:1 of less than 50 nM, e.g., less than 40 nM, less than 30 nM, less than 25 nM, less than 20 nM, less than 15 nM, less than 10 nM, less than 5 nM, less than 1 nM, less than 500 pM, less than 250 pM, less than 150 pM, less than 100 pM, less than 50 pM, less than 40 pM, less than 30 pM, less than 20 pM, or less than about 10 pM. In some embodiments, the antibody has a $K_D$ for SEQ ID NO:1 in the range of about 1 pM to about 50 nM, e.g., about 1 pM to about 25 nM, about 1 pM to about 10 nM, about 1 pM to about 5 nM, about 1 pM to about 500 pM, about 5 pM to about 250 pM, or about 10 pM to about 100 pM.

In some embodiments, an anti-Tau antibody specifically binds to more than one splice isoform of human Tau (e.g., two, three, four, five, or all six of the splice isoforms 2N4R, 2N3R, 1N4R, 1N3R, 0N4R, and 0N3R) with high affinity. In some embodiments, the antibody has a $K_D$ for two or more isoforms of human Tau of less than 50 nM, less than 40 nM, less than 30 nM, less than 25 nM, less than 20 nM, less than 15 nM, less than 10 nM, less than 5 nM, less than 1 nM, less than 500 pM, less than 250 pM, less than 150 pM, less than 100 pM, less than 50 pM, less than 40 pM, less than 30 pM, less than 20 pM, or less than about 10 pM. In some embodiments, the antibody has a $K_D$ for two or more isoforms of human Tau that is in the range of about 1 pM to about 50 nM, e.g., about 1 pM to about 25 nM, about 1 pM to about 10 nM, about 1 pM to about 5 nM, about 1 pM to about 500 pM, about 5 pM to about 250 pM, or about 10 pM to about 100 pM.

In some embodiments, the anti-Tau antibody exhibits cross-reactivity with cynomolgus monkey ("cyno") Tau (e.g., a cyno Tau protein having the sequence of SEQ ID NO:7). In some embodiments, the anti-Tau antibody exhibits cross-reactivity with mouse Tau (e.g., a mouse Tau protein having the sequence of SEQ ID NO:6). In some embodiments, the anti-Tau antibody exhibits cross-reactivity with cynomolgus monkey Tau (e.g., a cyno Tau protein having the sequence of SEQ ID NO:7) and mouse Tau (e.g., a mouse Tau protein having the sequence of SEQ ID NO:6).

Methods for analyzing binding affinity, binding kinetics, and cross-reactivity are known in the art. These methods include, but are not limited to, solid-phase binding assays (e.g., ELISA assay), immunoprecipitation, surface plasmon resonance (e.g., Biacore™ (GE Healthcare, Piscataway, N.J.)), kinetic exclusion assays (e.g., KinExA®), flow cytometry, fluorescence-activated cell sorting (FACS), Bio-Layer interferometry (e.g., Octet™ (FortéBio, Inc., Menlo Park, Calif.)), and Western blot analysis. In some embodiments, ELISA is used to determine binding affinity and/or cross-reactivity. Methods for performing ELISA assays are known in the art, and are also described in the Examples section below. In some embodiments, surface plasmon resonance (SPR) is used to determine binding affinity, binding kinetics, and/or cross-reactivity. In some embodiments, kinetic exclusion assays are used to determine binding affinity, binding kinetics, and/or cross-reactivity. In some embodiments, BioLayer interferometry assays are used to determine binding affinity, binding kinetics, and/or cross-reactivity.

In some embodiments, an anti-Tau antibody recognizes an epitope of human Tau having or consisting of the sequence TPSLEDEAAGHVTQA (SEQ ID NO:35), which corresponds to residues 111-125 of SEQ ID NO:1. In some embodiments, an anti-Tau antibody recognizes an epitope within residues 111-125 of SEQ ID NO:1. In some embodiments, an anti-Tau antibody recognizes an epitope comprising at least 4, at least 5, at least 6, at least 7, at least 8, at least 9, or at least 10 amino acids within residues 111-125 of SEQ ID NO:1. In some embodiments, an anti-Tau antibody recognizes an epitope comprising at least 4, at least 5, at least 6, at least 7, at least 8, at least 9, or at least 10 contiguous amino acids within residues 111-125 of SEQ ID NO:1. In some embodiments, an anti-Tau antibody recognizes an epitope comprising 4-15, 4-12, 4-10, 4-8, 5-15, 5-12, 5-10, 5-8, 6-15, 6-12, 6-10, 6-8, 8-15, 8-12, 8-10, 10-15, 10-12, or 12-15 contiguous amino acids within residues 111-125 of SEQ ID NO:1. In some embodiments, the epitope is not an epitope consisting of the sequence AAGHV (SEQ ID NO:632).

In some embodiments, an anti-Tau antibody recognizes an epitope of human Tau having or consisting of the sequence PDLKNVKSKIGSTENLKHQP (SEQ ID NO:36), which corresponds to residues 251-270 of SEQ ID NO:1. In some embodiments, an anti-Tau antibody recognizes an epitope within residues 251-270 of SEQ ID NO:1. In some embodiments, an anti-Tau antibody recognizes an epitope having or consisting of the sequence VKSKIGSTENLKHQP (SEQ ID NO:37), which corresponds to residues 256-270 of SEQ ID NO:1. In some embodiments, an anti-Tau antibody recognizes an epitope comprising or consisting of the sequence SKIGS (SEQ ID NO:39) within residues 251-270 of SEQ ID NO:1. In some embodiments, an anti-Tau antibody recognizes an epitope comprising at least 4, at least 5, at least 6, at least 7, at least 8, at least 9, or at least 10 amino acids within residues 251-270 of SEQ ID NO:1 or within residues 256-270 of SEQ ID NO:1. In some embodiments, an anti-Tau antibody recognizes an epitope comprising at least 4, at least 5, at least 6, at least 7, at least 8, at least 9, or at least 10 contiguous amino acids within residues 251-270 of SEQ ID NO:1 or within residues 256-270 of SEQ ID NO:1. In some embodiments, an anti-Tau antibody recognizes an epitope comprising 4-15, 4-12, 4-10, 4-8, 5-15, 5-12, 5-10, 5-8, 6-15, 6-12, 6-10, 6-8, 8-15, 8-12, 8-10, 10-15, 10-12, or 12-15 contiguous amino acids within residues 251-270 of SEQ ID NO:1 or within residues 256-270 of SEQ ID NO:1.

In some embodiments, an anti-Tau antibody recognizes an epitope of human Tau having or consisting of the sequence FKDRVQSKIGSLDNI (SEQ ID NO:38), which corresponds to residues 346-360 of SEQ ID NO:1. In some embodiments, an anti-Tau antibody recognizes an epitope within residues 346-360 of SEQ ID NO:1. In some embodiments, an anti-Tau antibody recognizes an epitope comprising or consisting of the sequence SKIGS (SEQ ID NO:52) within residues 346-360 of SEQ ID NO:1. In some embodiments, an anti-Tau antibody recognizes an epitope comprising at least 4, at least 5, at least 6, at least 7, at least 8, at least 9, or at least 10 amino acids within residues 346-360 of SEQ ID NO:1. In some embodiments, an anti-Tau antibody recognizes an epitope comprising at least 4, at least 5, at least 6, at least 7, at least 8, at least 9, or at least 10 contiguous amino acids within residues 346-360 of SEQ ID NO:1. In some embodiments, an anti-Tau antibody recognizes an epitope comprising 4-15, 4-12, 4-10, 4-8, 5-15, 5-12, 5-10, 5-8, 6-15, 6-12, 6-10, 6-8, 8-15, 8-12, 8-10, 10-15, 10-12, or 12-15 contiguous amino acids within residues 346-360 of SEQ ID NO:1.

In some embodiments, an anti-Tau antibody has a dual epitope specificity and recognizes both an epitope of human Tau having, consisting of, or within the sequence PDLKNVKSKIGSTENLKHQP (SEQ ID NO:36) corresponding to residues 251-270 of SEQ ID NO:1, and an epitope having, consisting of, or within the sequence FKDRVQSKIGSLDNI (SEQ ID NO:38) corresponding to residues 346-360 of SEQ ID NO:1. In some embodiments, an anti-Tau antibody is a dual epitope antibody that recognizes an epitope having, consisting of, or within the sequence VKSKIGSTENLKHQP (SEQ ID NO:37) corresponding to residues 256-270 of SEQ ID NO:1, and also recognizes an epitope having, consisting of, or within the sequence FKDRVQSKIGSLDNI (SEQ ID NO:38) corresponding to residues 346-360 of SEQ ID NO:1. In some embodiments, an anti-Tau antibody is a dual epitope antibody that recognizes an epitope of human Tau within residues 251-270 of SEQ ID NO:1 and also recognizes an epitope within residues 346-360 of SEQ ID NO:1. In some embodiments, an anti-Tau antibody is a dual epitope antibody that recognizes an epitope within residues 256-270 of SEQ ID NO:1 and also recognizes an epitope within residues 346-360 of SEQ ID NO:1. In some embodiments, an anti-Tau antibody recognizes an epitope comprising the sequence SKIGS (SEQ ID NO:39) within residues 251-270 of SEQ ID NO:1 and/or within residues 346-360 of SEQ ID NO:1.

In some embodiments, an anti-Tau antibody recognizes an epitope of human Tau having or consisting of the sequence GEPPKSGDRSGYSSPGSPGT (SEQ ID NO:178), which corresponds to residues 186-205 of SEQ ID NO:1. In some embodiments, an anti-Tau antibody recognizes an epitope within residues 186-205 of SEQ ID NO:1. In some embodiments, an anti-Tau antibody recognizes an epitope of human Tau having or consisting of the sequence GEPPKSGDRSGYSSP (SEQ ID NO:179), which corresponds to residues 186-200 of SEQ ID NO:1. In some embodiments, an anti-Tau antibody recognizes an epitope within residues 186-200 of SEQ ID NO:1. In some embodiments, an anti-Tau antibody recognizes an epitope of human Tau having or consisting of the sequence SGDRSGYSSPGSPGT (SEQ ID NO:180), which corresponds to residues 191-205 of SEQ ID NO:1. In some embodiments, an anti-Tau antibody recognizes an epitope within residues 191-205 of SEQ ID NO:1. In some embodiments, an anti-Tau antibody recognizes an epitope comprising at least 4, at least 5, at least 6, at least 7, at least 8, at least 9, or at least 10 amino acids within residues 186-205 of SEQ ID NO:1, within residues 186-200 of SEQ ID NO:1, or within residues 191-205 of SEQ ID NO:1. In some embodiments, an anti-Tau antibody recognizes an epitope comprising at least 4, at least 5, at least 6, at least 7, at least 8, at least 9, or at least 10 contiguous amino acids within residues 186-205 of SEQ ID NO:1, within residues 186-200 of SEQ ID NO:1, or within residues 191-205 of SEQ ID NO:1. In some embodiments, an anti-Tau antibody recognizes an epitope comprising 4-15, 4-12, 4-10, 4-8, 5-15, 5-12, 5-10, 5-8, 6-15, 6-12, 6-10, 6-8, 8-15, 8-12, 8-10, 10-15, 10-12, or 12-15 contiguous amino acids within residues 186-205 of SEQ ID NO:1, within residues 186-200 of SEQ ID NO:1, or within residues 191-205 of SEQ ID NO:1.

In some embodiments, an anti-Tau antibody recognizes an epitope of human Tau that is the same or substantially the same as the epitope recognized by an antibody clone selected from the group consisting of 19F7.C9 and 24D2.B2. In some embodiments, the epitope recognized by antibody clone 19F7.C9 or 24D2.B2 comprises one or more residues within residues 50-421 of SEQ ID NO:1. In some embodiments, the epitope recognized by antibody clone 19F7.C9 or 24D2.B2 is within residues 50-421 of SEQ ID NO:1. As used herein, the term "substantially the same," as used with reference to an epitope recognized by an antibody clone as described herein, means that the anti-Tau antibody recognizes an epitope that is identical, within, or nearly identical to (e.g., has at least 90% sequence identity to, or has one, two, or three amino acid substitutions, e.g., conservative substitutions, relative to), or has substantial overlap with (e.g., at least 50%, 60%, 70%, 80%, 90%, or 95% overlap with) the epitope recognized by the antibody clone as described herein.

Anti-Tau Antibody Sequences

In some embodiments, an antibody or antigen-binding portion thereof that specifically binds to a human Tau protein comprises a light chain sequence, or a portion thereof, and/or a heavy chain sequence, or a portion thereof, derived from any of the following antibodies described herein: Clone 1A1, Clone 1A5, Clone 1D10, Clone 1G7, Clone 1C7, Clone 1H G11, Clone 1H B12, Clone 17G2.A1, hu1C7.v1, hu1C7.v2, hu1C7.v3, hu1C7.v4, hu1C7.v2-1, and hu1C7.v2-2. The amino acid sequences of the light chain variable region (VL) and heavy chain variable region (VH) of these anti-Tau antibodies are as follows: Clone 1A1 (e.g., SEQ ID NOS:8 and 12), Clone 1A5 (e.g., SEQ ID NOS:16 and 19), Clone 1D10 (e.g., SEQ ID NOS:29 and 31), Clone 1G7 (e.g., SEQ ID NOS:32 and 34), Clone 1C7 (e.g., SEQ ID NOS:21 and 25), Clone 1H_G11 (e.g., SEQ ID NOS:40 and 41), Clone 1H_B12 (e.g., SEQ ID NOS:40 and 45), Clone 17G2.A1 (e.g., SEQ ID NOS:167 and 171), hu1C7.v1 (e.g., SEQ ID NOS:145 and 149), hu1C7.v2 (e.g., SEQ ID NOS:146 and 149), hu1C7.v3 (e.g., SEQ ID NOS: 147 and 149), hu1C7.v4 (e.g., SEQ ID NOS:148 and 149), hu1C7.v2-1 (e.g., SEQ ID NOS:146 and 463), and hu1C7.v2-2 (e.g., SEQ ID NOS:146 and 464).

In some embodiments, an anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOS:8, 16, 21, 29, 32, 40, 145-148, and 167. In some embodiments, an anti-Tau antibody comprises a heavy chain variable region comprising the amino acid sequence of any one of SEQ ID NOS:8, 16, 21, 29, 32, 40, 145-148, and 167. In some embodiments, a heavy chain variable region sequence having at least 90% sequence identity to a reference sequence (e.g., SEQ ID NOS:8, 16, 21, 29, 32, 40, 145-148, and 167) contains one, two, three, four, five, six, seven, eight, nine, ten or more substitutions (e.g., conservative substitutions), insertions, or deletions relative to the reference sequence but retains the ability to specifically bind to a human Tau protein and recognize one or more epitopes as described herein. In some embodiments, a heavy chain variable region contains one, two, or three substitutions (e.g., conservative substitutions) in any one of SEQ ID NOS:8, 16, 21, 29, 32, 40, 145-148, and 167.

In some embodiments, an anti-Tau antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOS:12, 19, 25, 31, 34, 41, 45, 149, 171, 463, and 464. In some embodiments, an anti-Tau antibody comprises a light chain variable region comprising the amino acid sequence of any one of SEQ ID NOS:12, 19, 25, 31, 34, 41, 45, 149, 171, 463, and 464. In some embodiments, a light chain variable region sequence having at least 90% sequence identity to a reference sequence (e.g., SEQ ID NOS:12, 19, 25, 31, 34, 41, 45, 149, 171, 463, and 464) contains one, two, three, four, five, six, seven, eight, nine, ten or more substitutions (e.g., conservative substitutions), insertions, or deletions relative to the reference sequence but retains the ability to bind to human Tau and recognize one or more epitopes as described herein. In some embodiments, a light chain variable region contains one, two, or three substitutions (e.g., conservative substitutions) in any one of SEQ ID NOS:12, 19, 25, 31, 34, 41, 45, 149, 171, 463, and 464.

In some embodiments, an anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOS:8, 16, 21, 29, 32, 40, 145-148, and 167 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOS:12, 19, 25, 31, 34, 41, 45, 149, 171, 463, and 464. In some embodiments, an anti-Tau antibody comprises a heavy chain variable region comprising the amino acid sequence of any one of SEQ ID NOS:8, 16, 21, 29, 32, 40, 145-148, and 167 and further comprises a light chain variable region comprising the amino acid sequence of any one of SEQ ID NOS:12, 19, 25, 31, 34, 41, 45, 149, 171, 463, and 464.

Anti-Tau Antibodies that Recognize an Epitope within Residues 111-125

In some embodiments, an anti-Tau antibody recognizes an epitope within residues 111-125 of SEQ ID NO:1 (e.g., an epitope comprising at least 6 contiguous amino acids within residues 111-125), or recognizes an epitope comprising or consisting of residues 111-125 of SEQ ID NO:1. In some embodiments, the anti-Tau antibody further comprises one or more complementarity determining region (CDR), heavy chain variable region, and/or light chain variable region sequences as described herein (e.g., as described in the Sequence Listing).

In some embodiments, an anti-Tau antibody specifically binds to a peptide having the sequence TPSLEDEAAGHVTQA (SEQ ID NO:70), which corresponds to residues 111-125 of SEQ ID NO:1. In some embodiments, the peptide sequence set forth in SEQ ID NO:70 is sufficient for binding to the anti-Tau antibody. In some embodiments, the anti-Tau antibody further comprises one or more complementarity determining region (CDR), heavy chain variable region, and/or light chain variable region sequences as described herein (e.g., as described in the Sequence Listing).

In some embodiments, an anti-Tau antibody comprises one or more CDRs selected from the group consisting of:
(a) a heavy chain CDR1 having at least 90% sequence identity to the amino acid sequence of SEQ ID NO:22 or having up to two amino acid substitutions relative to the amino acid sequence of SEQ ID NO:22;
(b) a heavy chain CDR2 having at least 90% sequence identity to the amino acid sequence of SEQ ID NO:23 or having up to two amino acid substitutions relative to the amino acid sequence of SEQ ID NO:23;
(c) a heavy chain CDR3 having at least 90% sequence identity to the amino acid sequence of SEQ ID NO:24 or having up to two amino acid substitutions relative to the amino acid sequence of SEQ ID NO:24;
(d) a light chain CDR1 having at least 90% sequence identity to the amino acid sequence of any one of SEQ ID NOS:26 and 42 or having up to two amino acid substitutions relative to the amino acid sequence of any one of SEQ ID NOS:26 and 42;
(e) a light chain CDR2 having at least 90% sequence identity to the amino acid sequence of any one of SEQ ID NOS:27, 43, and 50 or having up to two amino acid substitutions relative to the amino acid sequence of any one of SEQ ID NOS:27, 43, and 50; and
(f) a light chain CDR3 having at least 90% sequence identity to the amino acid sequence of any one of SEQ ID NOS:28, 44, 46, and 51 or having up to two amino acid substitutions relative to the amino acid sequence of any one of SEQ ID NOS:28, 44, 46, and 51.

In some embodiments, an anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f). In some embodiments, a CDR having up to two amino acid substitutions has one amino acid substitution relative to the reference sequence. In some embodiments, a CDR having up to two amino acid substitutions has two amino acid substitutions relative to the reference sequence. In some embodiments, the up to two amino acid substitutions are conservative substitutions.

In some embodiments, an anti-Tau antibody comprises one or more CDRs selected from the group consisting of:
  (a) a heavy chain CDR1 comprising the amino acid sequence of SEQ ID NO:22;
  (b) a heavy chain CDR2 comprising the amino acid sequence of SEQ ID NO:23;
  (c) a heavy chain CDR3 comprising the amino acid sequence of SEQ ID NOS:24;
  (d) a light chain CDR1 comprising the amino acid sequence of any one of SEQ ID NOS:26 and 42;
  (e) a light chain CDR2 comprising the amino acid sequence of any one of SEQ ID NOS:27, 43, and 50; and
  (f) a light chain CDR3 comprising the amino acid sequence of any one of SEQ ID NOS:28, 44, 46, and 51.

In some embodiments, an anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f).

In some embodiments, an anti-Tau antibody comprises one or more sequences that are variants of one or more consensus sequences. As a non-limiting example, consensus sequences can be identified by aligning heavy chain or light chain sequences (e.g., CDRs) for antibodies that are from the same (or similar) germlines. In some embodiments, consensus sequences may be generated from antibodies that contain sequences that are of the same (or similar) length and/or have at least one highly similar CDR (e.g., highly similar CDR3). In some embodiments, such sequences in these antibodies may be aligned and compared to identify conserved amino acids or motifs (i.e., where alteration in sequences may alter protein function) and/or regions where variation occurs the sequences (i.e., where variation of sequence is not likely to significantly affect protein function). Alternatively, consensus sequences can be identified by aligning heavy chain or light chain sequences (e.g., CDRs) for antibodies that bind to the same or similar (e.g., overlapping) epitopes to determine conserved amino acids or motifs (i.e., where alteration in sequences may alter protein function) and regions where variation occurs in alignment of sequences (i.e., where variation of sequence is not likely to significantly affect protein function). In some embodiments, one or more consensus sequences can be identified for antibodies that recognize the same or similar epitope as 1C7. Exemplary 1C7-like consensus sequences include SEQ ID NO:50 and SEQ ID NO:51. In the consensus sequences of SEQ ID NOS:50 and 51, the capitalized letter represents an amino acid residue that is absolutely conserved among the aligned sequences (e.g., aligned CDR sequences), while "x" represents an amino acid residue that is not absolutely conserved among the aligned sequences. It will be appreciated that when selecting an amino acid to insert at a position marked by an "x" that in some embodiments, the amino acid is selected from those amino acids found at the corresponding position in the aligned sequences.

In some embodiments, the antibody comprises a light chain CDR2 sequence having the consensus sequence WASxRxS (SEQ ID NO:50). In some embodiments, the light chain CDR2 consensus sequence comprises the sequence WAS[T/Y]R[E/Y]S (SEQ ID NO:633).

In some embodiments, the antibody comprises a light chain CDR3 sequence having the consensus sequence QQYxxYPLT (SEQ ID NO:51). In some embodiments, the light chain CDR3 consensus sequence comprises the sequence QQY[N/S][S/T]YPLT (SEQ ID NO:634).

In some embodiments, an anti-Tau antibody binds to at least one of the following residues T111, P112, S113, L114, E115, D116, E117, A118, A119, G120, H121, V122, T123, Q124, or A125 of SEQ ID NO:1. In some embodiments, an anti-Tau antibody binds to at least two, three, four, five, six, seven, eight, nine, ten, eleven, twelve, thirteen, fourteen, or all fifteen of the following residues T111, P112, S113, L114, E115, D116, E117, A118, A119, G120, H121, V122, T123, Q124, or A125 of SEQ ID NO:1. In some embodiments, the anti-Tau antibody binds to contiguous residues of SEQ ID NO:1. In some embodiments, the anti-Tau antibody binds to non-contiguous residues of SEQ ID NO:1. In some embodiments, the anti-Tau antibody binds to both contiguous and non-contiguous residues of SEQ ID NO:1.

In some embodiments, an anti-Tau antibody binds to at least residue T111 of SEQ ID NO:1. In some embodiments, an anti-Tau antibody binds to at least residue P112 of SEQ ID NO:1. In some embodiments, an anti-Tau antibody binds to at least residue S113 of SEQ ID NO:1. In some embodiments, an anti-Tau antibody binds to at least residue L114 of SEQ ID NO:1. In some embodiments, an anti-Tau antibody binds to at least residue E115 of SEQ ID NO:1. In some embodiments, an anti-Tau antibody binds to at least residue D116 of SEQ ID NO:1. In some embodiments, an anti-Tau antibody binds to at least residue E117 of SEQ ID NO:1. In some embodiments, an anti-Tau antibody binds to at least residue A118 of SEQ ID NO:1. In some embodiments, an anti-Tau antibody binds to at least residue A119 of SEQ ID NO:1. In some embodiments, an anti-Tau antibody binds to at least residue G120 of SEQ ID NO:1. In some embodiments, an anti-Tau antibody binds to at least residue H121 of SEQ ID NO:1. In some embodiments, an anti-Tau antibody binds to at least residue V122 of SEQ ID NO:1. In some embodiments, an anti-Tau antibody binds to at least residue T123 of SEQ ID NO:1. In some embodiments, an anti-Tau antibody binds to at least residue Q124 of SEQ ID NO:1. In some embodiments, an anti-Tau antibody binds to at least residue A125 of SEQ ID NO:1. In some embodiments, an anti-Tau antibody binds to at least residues L114 and E115 of SEQ ID NO:1.

In some embodiments, an anti-Tau antibody that recognizes an epitope within residues 111-125 of SEQ ID NO:1 prevents, reduces, or inhibits pathological Tau seeding and/or spreading, e.g., by at least 10%, 15%, 20%, 25%, 30%, 35%, 40%, 45%, 50%, 55%, 60%, 65%, 70%, 75%, 80%, 85%, 90%, or 95% (e.g., compared to the amount of pathological Tau seeding and/or spreading in the absence of the anti-Tau antibody). In some embodiments, an anti-Tau antibody that recognizes an epitope within residues 111-125 of SEQ ID NO:1 prevents, reduces, or inhibits Tau oligomerization, e.g., by at least 10%, 15%, 20%, 25%, 30%, 35%, 40%, 45%, 50%, 55%, 60%, 65%, 70%, 75%, 80%, 85%, 90%, or 95% (e.g., compared to the amount of Tau oligomerization in the absence of the anti-Tau antibody). In some embodiments, an anti-Tau antibody that recognizes an epitope within residues 111-125 of SEQ ID NO:1 prevents, reduces, or inhibits Tau aggregation, e.g., by at least 10%, 15%, 20%, 25%, 30%, 35%, 40%, 45%, 50%, 55%, 60%, 65%, 70%, 75%, 80%, 85%, 90%, or 95% (e.g., compared to the amount of Tau aggregation in the absence of the anti-Tau antibody). In some embodiments, an anti-Tau antibody that recognizes an epitope within residues 111-125 of SEQ ID NO:1 prevents, reduces, or inhibits the binding of another anti-Tau antibody, e.g., by at least 10%, 15%, 20%, 25%, 30%, 35%, 40%, 45%, 50%, 55%, 60%, 65%, 70%, 75%, 80%, 85%, 90%, or 95% (e.g., compared to antibody binding in the absence of the anti-Tau antibody that recognizes an epitope within residues 111-125 of SEQ ID NO:1). Methods for measuring Tau seeding, spreading, oligomerization, and/or aggregation are known in the art. A specific example of one such method for measuring Tau seeding and/or aggregation is described in Example 2.

1C7

In some embodiments, an anti-Tau antibody comprises a heavy chain CDR1 sequence comprising the amino acid sequence of SEQ ID NO:22, a heavy chain CDR2 sequence comprising the amino acid sequence of SEQ ID NO:23, and a heavy chain CDR3 sequence comprising the amino acid sequence of SEQ ID NO:24. In some embodiments, an anti-Tau antibody comprises a light chain CDR1 sequence comprising the amino acid sequence of SEQ ID NO:26, a light chain CDR2 sequence comprising the amino acid sequence of SEQ ID NO:27, and a light chain CDR3 sequence comprising the amino acid sequence of SEQ ID NO:28. In some embodiments, an anti-Tau antibody comprises a heavy chain CDR1-3 and a light chain CDR1-3 comprising the amino acid sequences of SEQ ID NOS:22, 23, 24, 26, 27, and 28, respectively.

In some embodiments, an anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:21. In some embodiments, an anti-Tau antibody comprises a heavy chain variable region comprising the amino acid sequence of SEQ ID NO:21.

In some embodiments, an anti-Tau antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:25. In some embodiments, an anti-Tau antibody comprises a light chain variable region comprising the amino acid sequence of SEQ ID NO:25.

In some embodiments, an anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:21 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:25. In some embodiments, an anti-Tau antibody comprises a heavy chain variable region comprising the amino acid sequence of SEQ ID NO:21 and further comprises a light chain variable region comprising the amino acid sequence of SEQ ID NO:25.

In some embodiments, an anti-Tau antibody is an antibody that competes for binding with an antibody as described herein (e.g., an antibody comprising a heavy chain CDR1-3 and a light chain CDR1-3 comprising the amino acid sequences of SEQ ID NOS:22, 23, 24, 26, 27, and 28, respectively, or an antibody comprising a heavy chain variable region comprising the amino acid sequence of SEQ ID NO:21 and further comprising a light chain variable region comprising the amino acid sequence of SEQ ID NO:25).

In some embodiments, an anti-Tau antibody comprises a light chain having the sequence of SEQ ID NO:315, a first heavy chain having the sequence of SEQ ID NO:316, and a second heavy chain having the sequence of SEQ ID NO:317.

The epitope recognized by clone 1C7 is advantageous relative to binding sites of benchmark antibodies as it recognizes truncated forms of Tau that are not recognized by antibodies directed against N-terminal or C-terminal epitopes.

1H_G11

In some embodiments, an anti-Tau antibody comprises a heavy chain CDR1 sequence comprising the amino acid sequence of SEQ ID NO:22, a heavy chain CDR2 sequence comprising the amino acid sequence of SEQ ID NO:23, and a heavy chain CDR3 sequence comprising the amino acid sequence of SEQ ID NO:24. In some embodiments, an anti-Tau antibody comprises a light chain CDR1 sequence comprising the amino acid sequence of SEQ ID NO:42, a light chain CDR2 sequence comprising the amino acid sequence of SEQ ID NO:43, and a light chain CDR3 sequence comprising the amino acid sequence of SEQ ID NO:44. In some embodiments, an anti-Tau antibody comprises a heavy chain CDR1-3 and a light chain CDR1-3 comprising the amino acid sequences of SEQ ID NOS:22, 23, 24, 42, 43, and 44, respectively.

In some embodiments, an anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:40. In some embodiments, an anti-Tau antibody comprises a heavy chain variable region comprising the amino acid sequence of SEQ ID NO:40.

In some embodiments, an anti-Tau antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:41. In some embodiments, an anti-Tau antibody comprises a light chain variable region comprising the amino acid sequence of SEQ ID NO:41.

In some embodiments, an anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:40 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:41. In some embodiments, an anti-Tau antibody comprises a heavy chain variable region comprising the amino acid sequence of SEQ ID NO:40 and further comprises a light chain variable region comprising the amino acid sequence of SEQ ID NO:41.

In some embodiments, an anti-Tau antibody is an antibody that competes for binding with an antibody as described herein (e.g., an antibody comprising a heavy chain CDR1-3 and a light chain CDR1-3 comprising the amino acid sequences of SEQ ID NOS:22, 23, 24, 42, 43, and 44, respectively, or an antibody comprising a heavy chain variable region comprising the amino acid sequence of SEQ ID NO:40 and further comprising a light chain variable region comprising the amino acid sequence of SEQ ID NO:41).

1H_B12

In some embodiments, an anti-Tau antibody comprises a heavy chain CDR1 sequence comprising the amino acid sequence of SEQ ID NO:22, a heavy chain CDR2 sequence comprising the amino acid sequence of SEQ ID NO:23, and a heavy chain CDR3 sequence comprising the amino acid sequence of SEQ ID NO:24. In some embodiments, an anti-Tau antibody comprises a light chain CDR1 sequence comprising the amino acid sequence of SEQ ID NO:42, a light chain CDR2 sequence comprising the amino acid sequence of SEQ ID NO:43, and a light chain CDR3 sequence comprising the amino acid sequence of SEQ ID NO:46. In some embodiments, an anti-Tau antibody comprises a heavy chain CDR1-3 and a light chain CDR1-3 comprising the amino acid sequences of SEQ ID NOS:22, 23, 24, 42, 43, and 46, respectively.

In some embodiments, an anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:40. In some embodiments, an anti-Tau antibody comprises a heavy chain variable region comprising the amino acid sequence of SEQ ID NO:40.

In some embodiments, an anti-Tau antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:45. In some embodiments, an anti-Tau antibody comprises a light chain variable region comprising the amino acid sequence of SEQ ID NO:45.

In some embodiments, an anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:40 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:45. In some embodiments, an anti-Tau antibody comprises a heavy chain variable region comprising the amino acid sequence of SEQ ID NO:40 and further comprises a light chain variable region comprising the amino acid sequence of SEQ ID NO:45.

In some embodiments, an anti-Tau antibody is an antibody that competes for binding with an antibody as described herein (e.g., an antibody comprising a heavy chain CDR1-3 and a light chain CDR1-3 comprising the amino acid sequences of SEQ ID NOS:22, 23, 24, 42, 43, and 46, respectively, or an antibody comprising a heavy chain variable region comprising the amino acid sequence of SEQ ID NO:40 and further comprising a light chain variable region comprising the amino acid sequence of SEQ ID NO:45).

Anti-Tau Antibodies that Recognize an Epitope within Residues 251-270 and/or Residues 346-360

In some embodiments, an anti-Tau antibody recognizes an epitope within residues 251-270 of SEQ ID NO:1 (e.g., an epitope within residues 256-270 of SEQ ID NO:1, or an epitope comprising the sequence SKIGS within residues 251-270) and/or recognizes an epitope within residues 346-360 (e.g., an epitope comprising the sequence SKIGS within residues 346-360). In some embodiments, an anti-Tau antibody recognizes both an epitope within residues 251-270 of SEQ ID NO:1 (e.g., an epitope within residues 256-270 of SEQ ID NO:1, or an epitope comprising the sequence SKIGS within residues 251-270) and an epitope within residues 346-360 (e.g., an epitope comprising the sequence SKIGS within residues 346-360). In some embodiments, the antibody further comprises one or more complementarity determining region (CDR), heavy chain variable region, and/or light chain variable regions as described herein (e.g., as described in the Sequence Listing).

In some embodiments, an anti-Tau antibody specifically binds to a peptide having the sequence PDLKNVKSKIGSTEN (SEQ ID NO:113), which corresponds to residues 251-265 of SEQ ID NO:1. In some embodiments, the peptide sequence set forth in SEQ ID NO:113 is sufficient for binding to the anti-Tau antibody. In some embodiments, the anti-Tau antibody further comprises one or more complementarity determining region (CDR), heavy chain variable region, and/or light chain variable region sequences as described herein (e.g., as described in the Sequence Listing).

In some embodiments, an anti-Tau antibody specifically binds to a peptide having the sequence VKSKIGSTENLKHQP (SEQ ID NO:112), which corresponds to residues 256-270 of SEQ ID NO:1. In some embodiments, the peptide sequence set forth in SEQ ID NO:112 is sufficient for binding to the anti-Tau antibody. In some embodiments, the anti-Tau antibody further comprises one or more complementarity determining region (CDR), heavy chain variable region, and/or light chain variable region sequences as described herein (e.g., as described in the Sequence Listing).

In some embodiments, an anti-Tau antibody specifically binds to a peptide having the sequence FKDRVQSKIGSLDNI (SEQ ID NO:117), which corresponds to residues 346-360 of SEQ ID NO: 1. In some embodiments, the peptide sequence set forth in SEQ ID NO:117 is sufficient for binding to the anti-Tau antibody. In some embodiments, the anti-Tau antibody further comprises one or more complementarity determining region (CDR), heavy chain variable region, and/or light chain variable region sequences as described herein (e.g., as described in the Sequence Listing).

In some embodiments, an anti-Tau antibody comprises one or more CDRs selected from the group consisting of:
(a) a heavy chain CDR1 having at least 90% sequence identity to the amino acid sequence of any one of SEQ ID NOS:9, 17, and 47 or having up to two amino acid substitutions relative to the amino acid sequence of any one of SEQ ID NOS:9, 17, and 47;
(b) a heavy chain CDR2 having at least 90% sequence identity to the amino acid sequence of SEQ ID NO:10 or having up to two amino acid substitutions relative to the amino acid sequence of SEQ ID NO:10;

(c) a heavy chain CDR3 having at least 90% sequence identity to the amino acid sequence of any one of SEQ ID NOS:11, 18, 30, 33, and 48 or having up to two amino acid substitutions relative to the amino acid sequence of any one of SEQ ID NOS:11, 18, 30, 33, and 48;

(d) a light chain CDR1 having at least 90% sequence identity to the amino acid sequence of SEQ ID NO:13 or having up to two amino acid substitutions relative to the amino acid sequence of SEQ ID NO:13;

(e) a light chain CDR2 having at least 90% sequence identity to the amino acid sequence of SEQ ID NO:14 or having up to two amino acid substitutions relative to the amino acid sequence of SEQ ID NO:14; and (f) a light chain CDR3 having at least 90% sequence identity to the amino acid sequence of any one of SEQ ID NOS:15, 20, and 49 or having up to two amino acid substitutions relative to the amino acid sequence of any one of SEQ ID NOS:15, 20, and 49.

In some embodiments, an anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f). In some embodiments, a CDR having up to two amino acid substitutions has one amino acid substitution relative to the reference sequence. In some embodiments, a CDR having up to two amino acid substitutions has two amino acid substitutions relative to the reference sequence. In some embodiments, the up to two amino acid substitutions are conservative substitutions.

In some embodiments, an anti-Tau antibody comprises one or more CDRs selected from the group consisting of:

(a) a heavy chain CDR1 comprising the amino acid sequence of any one of SEQ ID NOS:9, 17, and 47;

(b) a heavy chain CDR2 comprising the amino acid sequence of SEQ ID NO:10;

(c) a heavy chain CDR3 comprising the amino acid sequence of any one of SEQ ID NOS:11, 18, 30, 33, and 48;

(d) a light chain CDR1 comprising the amino acid sequence of SEQ ID NO:13;

(e) a light chain CDR2 comprising the amino acid sequence of SEQ ID NO:14; and (f) a light chain CDR3 comprising the amino acid sequence of any one of SEQ ID NOS:15, 20, and 49.

In some embodiments, an anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f).

In some embodiments, an anti-Tau antibody comprises one or more consensus sequences. In some embodiments, one or more consensus sequences can be identified for antibodies that recognize the same or similar epitope or epitopes as 1A1. Exemplary 1A1-like consensus sequences include SEQ ID NO:47, SEQ ID NO:48, and SEQ ID NO:49. In the consensus sequences of SEQ ID NOS:47-49, the capitalized letter represents an amino acid residue that is absolutely conserved among the aligned sequences (e.g., aligned CDR sequences), while "x" represents an amino acid residue that is not absolutely conserved among the aligned sequences. It will be appreciated that when selecting an amino acid to insert at a position marked by an "x" that in some embodiments, the amino acid is selected from those amino acids found at the corresponding position in the aligned sequences.

In some embodiments, the antibody comprises a heavy chain CDR1 sequence having the consensus sequence GFNIKDSLxH (SEQ ID NO:47). In some embodiments, the heavy chain CDR1 consensus sequence comprises a methionine (M) or isoleucine (I) amino acid at the variable residue ("x").

In some embodiments, the antibody comprises a heavy chain CDR3 sequence having the consensus sequence xRRDWEGP (SEQ ID NO:48). In some embodiments, the heavy chain CDR3 consensus sequence comprises an alanine (A) or threonine (T) amino acid at the variable residue ("x").

In some embodiments, the antibody comprises a light chain CDR3 sequence having the consensus sequence VQGTHFPxT (SEQ ID NO:49). In some embodiments, the light chain CDR3 consensus sequence comprises a phenylalanine (F) or tyrosine (Y) amino acid at the variable ("x") residue.

In some embodiments, an anti-Tau antibody binds to at least one of the following residues P251, D252, L253, K254, N255, V256, K257, S258, K259, I260, G261, S262, T263, E264, N265, L266, K267, H268, Q269, or P270 of SEQ ID NO:1. In some embodiments, an anti-Tau antibody binds to at least one of the following residues F346, K347, D348, R349, V350, Q351, S352, K353, I354, G355, S356, L357, D358, N359, or I360 of SEQ ID NO:1. In some embodiments, an anti-Tau antibody binds to at least one of the following residues P251, D252, L253, K254, N255, V256, K257, S258, K259, I260, G261, S262, T263, E264, N265, L266, K267, H268, Q269, or P270 of SEQ ID NO:1 and at least one of the following residues F346, K347, D348, R349, V350, Q351, S352, K353, I354, G355, S356, L357, D358, N359, or I360 of SEQ ID NO:1.

In some embodiments, an anti-Tau antibody binds to at least two, three, four, five, six, seven, eight, nine, ten, eleven, twelve, thirteen, fourteen, fifteen, sixteen, seventeen, eighteen, nineteen, or all twenty of the following residues P251, D252, L253, K254, N255, V256, K257, S258, K259, I260, G261, S262, T263, E264, N265, L266, K267, H268, Q269, or P270 of SEQ ID NO:1. In some embodiments, an anti-Tau antibody binds to at least two, three, four, five, six, seven, eight, nine, ten, eleven, twelve, thirteen, fourteen, or all fifteen of the following residues F346, K347, D348, R349, V350, Q351, S352, K353, I354, G355, S356, L357, D358, N359, or I360 of SEQ ID NO:1. In some embodiments, an anti-Tau antibody binds to at least two, three, four, five, six, seven, eight, nine, ten, eleven, twelve, thirteen, fourteen, fifteen, sixteen, seventeen, eighteen, nineteen, or all twenty of the following residues P251, D252, L253, K254, N255, V256, K257, S258, K259, I260, G261, S262, T263, E264, N265, L266, K267, H268, Q269, or P270 of SEQ ID NO:1 and at least two, three, four, five, six, seven, eight, nine, ten, eleven, twelve, thirteen, fourteen, or all fifteen of the following residues F346, K347, D348, R349, V350, Q351, S352, K353, I354, G355, S356, L357, D358, N359, or I360 of SEQ ID NO:1.

In some embodiments, the anti-Tau antibody binds to contiguous residues of SEQ ID NO:1 (e.g., two or more residues within residues 251-270 of SEQ ID NO:1 or two or more residues within residues 346-360 of SEQ ID NO:1). In some embodiments, the anti-Tau antibody binds to non-contiguous residues of SEQ ID NO:1 (e.g., one or more residues within residues 251-270 of SEQ ID NO:1 and/or one or more residues within residues 346-360 of SEQ ID NO:1). In some embodiments, the anti-Tau antibody binds to both contiguous and non-contiguous residues of SEQ ID NO:1.

In some embodiments, an anti-Tau antibody binds to at least residue P251 of SEQ ID NO:1. In some embodiments, an anti-Tau antibody binds to at least residue D252 of SEQ ID NO:1. In some embodiments, an anti-Tau antibody binds to at least residue L253 of SEQ ID NO:1. In some embodiments, an anti-Tau antibody binds to at least residue K254 of SEQ ID NO:1. In some embodiments, an anti-Tau antibody binds to at least residue N255 of SEQ ID NO:1. In some embodiments, an anti-Tau antibody binds to at least residue V256 of SEQ ID NO:1. In some embodiments, an anti-Tau antibody binds to at least residue K257 of SEQ ID NO:1. In some embodiments, an anti-Tau antibody binds to at least residue S258 of SEQ ID NO:1. In some embodiments, an anti-Tau antibody binds to at least residue K259 of SEQ ID NO:1. In some embodiments, an anti-Tau antibody binds to at least residue 1260 of SEQ ID NO:1. In some embodiments, an anti-Tau antibody binds to at least residue G261 of SEQ ID NO:1. In some embodiments, an anti-Tau antibody binds to at least residue S262 of SEQ ID NO:1. In some embodiments, an anti-Tau antibody binds to at least residue T263 of SEQ ID NO:1. In some embodiments, an anti-Tau antibody binds to at least residue E264 of SEQ ID NO: 1. In some embodiments, an anti-Tau antibody binds to at least residue N265 of SEQ ID NO:1. In some embodiments, an anti-Tau antibody binds to at least residue L266 of SEQ ID NO: 1. In some embodiments, an anti-Tau antibody binds to at least residue K267 of SEQ ID NO:1. In some embodiments, an anti-Tau antibody binds to at least residue H268 of SEQ ID NO:1. In some embodiments, an anti-Tau antibody binds to at least residue Q269 of SEQ ID NO:1. In some embodiments, an anti-Tau antibody binds to at least residue P270 of SEQ ID NO:1.

In some embodiments, an anti-Tau antibody binds to at least residue F346 of SEQ ID NO:1. In some embodiments, an anti-Tau antibody binds to at least residue K347 of SEQ ID NO:1. In some embodiments, an anti-Tau antibody binds to at least residue D348 of SEQ ID NO:1. In some embodiments, an anti-Tau antibody binds to at least residue R349 of SEQ ID NO:1. In some embodiments, an anti-Tau antibody binds to at least residue V350 of SEQ ID NO:1. In some embodiments, an anti-Tau antibody binds to at least residue Q351 of SEQ ID NO:1. In some embodiments, an anti-Tau antibody binds to at least residue 5352 of SEQ ID NO:1. In some embodiments, an anti-Tau antibody binds to at least residue K353 of SEQ ID NO:1. In some embodiments, an anti-Tau antibody binds to at least residue 1354 of SEQ ID NO:1. In some embodiments, an anti-Tau antibody binds to at least residue G355 of SEQ ID NO:1. In some embodiments, an anti-Tau antibody binds to at least residue 5356 of SEQ ID NO:1. In some embodiments, an anti-Tau antibody binds to at least residue L357 of SEQ ID NO:1. In some embodiments, an anti-Tau antibody binds to at least residue D358 of SEQ ID NO:1. In some embodiments, an anti-Tau antibody binds to at least residue N359 of SEQ ID NO:1. In some embodiments, an anti-Tau antibody binds to at least residue I360 of SEQ ID NO:1.

In some embodiments, an anti-Tau antibody that recognizes an epitope within residues 251-270 of SEQ ID NO:1 and/or an epitope within residues 346-360 of SEQ ID NO:1 prevents, reduces, or inhibits pathological Tau seeding and/or spreading, e.g., by at least 10%, 15%, 20%, 25%, 30%, 35%, 40%, 45%, 50%, 55%, 60%, 65%, 70%, 75%, 80%, 85%, 90%, or 95% (e.g., compared to the amount of pathological Tau seeding and/or spreading in the absence of the anti-Tau antibody). In some embodiments, an anti-Tau antibody that recognizes an epitope within residues 251-270 of SEQ ID NO:1 and/or an epitope within residues 346-360 of SEQ ID NO:1 prevents, reduces, or inhibits Tau oligomerization, e.g., by at least 10%, 15%, 20%, 25%, 30%, 35%, 40%, 45%, 50%, 55%, 60%, 65%, 70%, 75%, 80%, 85%, 90%, or 95% (e.g., compared to the amount of Tau oligomerization in the absence of the anti-Tau antibody). In some embodiments, an anti-Tau antibody that recognizes an epitope within residues 251-270 of SEQ ID NO:1 and/or an epitope within residues 346-360 of SEQ ID NO:1 prevents, reduces, or inhibits Tau aggregation, e.g., by at least 10%, 15%, 20%, 25%, 30%, 35%, 40%, 45%, 50%, 55%, 60%, 65%, 70%, 75%, 80%, 85%, 90%, or 95% (e.g., compared to the amount of Tau aggregation in the absence of the anti-Tau antibody). In some embodiments, an anti-Tau antibody that recognizes an epitope within residues 251-270 of SEQ ID NO:1 and/or an epitope within residues 346-360 of SEQ ID NO:1 prevents, reduces, or inhibits the binding of another anti-Tau antibody, e.g., by at least 10%, 15%, 20%, 25%, 30%, 35%, 40%, 45%, 50%, 55%, 60%, 65%, 70%, 75%, 80%, 85%, 90%, or 95% (e.g., compared to antibody binding in the absence of the anti-Tau antibody that recognizes an epitope within residues 251-270 of SEQ ID NO:1 and/or an epitope within residues 346-360 of SEQ ID NO:1). Methods for measuring Tau seeding, spreading, oligomerization, and/or aggregation are known in the art. A specific example of one such method for measuring Tau seeding and/or aggregation is described in Example 2.

1A1

In some embodiments, an anti-Tau antibody comprises a heavy chain CDR1 sequence comprising the amino acid sequence of SEQ ID NO:9, a heavy chain CDR2 sequence comprising the amino acid sequence of SEQ ID NO:10, and a heavy chain CDR3 sequence comprising the amino acid sequence of SEQ ID NO:11. In some embodiments, an anti-Tau antibody comprises a light chain CDR1 sequence comprising the amino acid sequence of SEQ ID NO:13, a light chain CDR2 sequence comprising the amino acid sequence of SEQ ID NO:14, and a light chain CDR3 sequence comprising the amino acid sequence of SEQ ID NO:15. In some embodiments, an anti-Tau antibody comprises a heavy chain CDR1-3 and a light chain CDR1-3 comprising the amino acid sequences of SEQ ID NOS:9, 10, 11, 13, 14, and 15, respectively.

In some embodiments, an anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:8. In some embodiments, an anti-Tau antibody comprises a heavy chain variable region comprising the amino acid sequence of SEQ ID NO:8.

In some embodiments, an anti-Tau antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:12. In some embodiments, an anti-Tau antibody comprises a light chain variable region comprising the amino acid sequence of SEQ ID NO:12.

In some embodiments, an anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:8 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:12. In some embodiments, an anti-Tau antibody comprises a heavy chain variable region comprising the amino acid sequence of SEQ ID NO:8 and further comprises a light chain variable region comprising the amino acid sequence of SEQ ID NO:12.

In some embodiments, an anti-Tau antibody is an antibody that competes for binding with an antibody as described herein (e.g., an antibody comprising a heavy chain CDR1-3 and a light chain CDR1-3 comprising the amino acid sequences of SEQ ID NOS:9, 10, 11, 13, 14, and 15, respectively, or an antibody comprising a heavy chain variable region comprising the amino acid sequence of SEQ ID NO:8 and further comprising a light chain variable region comprising the amino acid sequence of SEQ ID NO:12).

In some embodiments, the anti-Tau antibody having one or more CDR sequences, heavy chain variable region sequences, and/or light chain variable region sequences as described herein recognizes an unphosphorylated epitope within residues 251-270 of SEQ ID NO:1. In some embodiments, the antibody recognizes a phosphorylated epitope within residues 251-270 of SEQ ID NO:1. In some embodiments, the antibody recognizes a phosphorylated epitope within residues 251-270 of SEQ ID NO:1 that is phosphorylated at residue Ser258. In some embodiments, the antibody recognizes a phosphorylated epitope within residues 251-270 of SEQ ID NO:1 that is phosphorylated at residue Ser262. In some embodiments, the antibody recognizes a phosphorylated epitope within residues 251-270 of SEQ ID NO:1 that is phosphorylated at both residue Ser258 and residue Ser262.

In some embodiments, the anti-Tau antibody having one or more CDR sequences, heavy chain variable region sequences, and/or light chain variable region sequences as described herein recognizes an unphosphorylated epitope within residues 346-360 epitope of SEQ ID NO:1. In some embodiments, the antibody recognizes a phosphorylated epitope within residues 346-360 of SEQ ID NO:1. In some embodiments, the antibody recognizes a phosphorylated epitope within residues 346-360 of SEQ ID NO:1 that is phosphorylated at residue Ser352. In some embodiments, the antibody recognizes a phosphorylated epitope within residues 346-360 of SEQ ID NO:1 that is phosphorylated at residue Ser356. In some embodiments, the antibody does not recognize a phosphorylated epitope within residues 346-360 of SEQ ID NO:1 that is phosphorylated at both residue Ser352 and residue Ser356.

1A5

In some embodiments, an anti-Tau antibody comprises a heavy chain CDR1 sequence comprising the amino acid sequence of SEQ ID NO:17, a heavy chain CDR2 sequence comprising the amino acid sequence of SEQ ID NO:10, and a heavy chain CDR3 sequence comprising the amino acid sequence of SEQ ID NO:18. In some embodiments, an anti-Tau antibody comprises a light chain CDR1 sequence comprising the amino acid sequence of SEQ ID NO:13, a light chain CDR2 sequence comprising the amino acid sequence of SEQ ID NO:14, and a light chain CDR3 sequence comprising the amino acid sequence of SEQ ID NO:20. In some embodiments, an anti-Tau antibody comprises a heavy chain CDR1-3 and a light chain CDR1-3 comprising the amino acid sequences of SEQ ID NOS:17, 10, 18, 13, 14, and 20, respectively.

In some embodiments, an anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:16. In some embodiments, an anti-Tau antibody comprises a heavy chain variable region comprising the amino acid sequence of SEQ ID NO:16.

In some embodiments, an anti-Tau antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:19. In some embodiments, an anti-Tau antibody comprises a light chain variable region comprising the amino acid sequence of SEQ ID NO:19.

In some embodiments, an anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:16 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:19. In some embodiments, an anti-Tau antibody comprises a heavy chain variable region comprising the amino acid sequence of SEQ ID NO:16 and further comprises a light chain variable region comprising the amino acid sequence of SEQ ID NO:19.

In some embodiments, an anti-Tau antibody is an antibody that competes for binding with an antibody as described herein (e.g., an antibody comprising a heavy chain CDR1-3 and a light chain CDR1-3 comprising the amino acid sequences of SEQ ID NOS:17, 10, 18, 13, 14, and 20, respectively, or an antibody comprising a heavy chain variable region comprising the amino acid sequence of SEQ ID NO:16 and further comprising a light chain variable region comprising the amino acid sequence of SEQ ID NO:19).

In some embodiments, the anti-Tau antibody having one or more CDR sequences, heavy chain variable region sequences, and/or light chain variable region sequences as described herein recognizes an unphosphorylated epitope within residues 251-270 of SEQ ID NO:1. In some embodiments, the antibody recognizes a phosphorylated epitope within residues 251-270 of SEQ ID NO:1. In some embodiments, the antibody recognizes a phosphorylated epitope within residues 251-270 of SEQ ID NO:1 that is phosphorylated at residue Ser258. In some embodiments, the antibody does not recognize a phosphorylated epitope within residues 251-270 of SEQ ID NO:1 that is phosphorylated at residue Ser262 or that is phosphorylated at both residue Ser258 and residue Ser262.

In some embodiments, the anti-Tau antibody having one or more CDR sequences, heavy chain variable region sequences, and/or light chain variable region sequences as described herein recognizes an unphosphorylated epitope within residues 346-360 of SEQ ID NO:1. In some embodiments, the antibody does not recognize a phosphorylated epitope within residues 346-360 of SEQ ID NO:1.

1D10

In some embodiments, an anti-Tau antibody comprises a heavy chain CDR1 sequence comprising the amino acid sequence of SEQ ID NO:9, a heavy chain CDR2 sequence comprising the amino acid sequence of SEQ ID NO:10, and a heavy chain CDR3 sequence comprising the amino acid sequence of SEQ ID NO:30. In some embodiments, an anti-Tau antibody comprises a light chain CDR1 sequence comprising the amino acid sequence of SEQ ID NO:13, a light chain CDR2 sequence comprising the amino acid sequence of SEQ ID NO:14, and a light chain CDR3 sequence comprising the amino acid sequence of SEQ ID NO:20. In some embodiments, an anti-Tau antibody comprises a heavy chain CDR1-3 and a light chain CDR1-3 comprising the amino acid sequences of SEQ ID NOS:9, 10, 30, 13, 14, and 20, respectively.

In some embodiments, an anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:29. In some embodiments, an anti-Tau antibody comprises a heavy chain variable region comprising the amino acid sequence of SEQ ID NO:29.

In some embodiments, an anti-Tau antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:31. In some embodiments, an anti-Tau antibody comprises a light chain variable region comprising the amino acid sequence of SEQ ID NO:31.

In some embodiments, an anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:29 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:31. In some embodiments, an anti-Tau antibody comprises a heavy chain variable region comprising the amino acid sequence of SEQ ID NO:29 and further comprises a light chain variable region comprising the amino acid sequence of SEQ ID NO:31.

In some embodiments, an anti-Tau antibody is an antibody that competes for binding with an antibody as described herein (e.g., an antibody comprising a heavy chain CDR1-3 and a light chain CDR1-3 comprising the amino acid sequences of SEQ ID NOS:9, 10, 30, 13, 14, and 20, respectively, or an antibody comprising a heavy chain variable region comprising the amino acid sequence of SEQ ID NO:29 and further comprising a light chain variable region comprising the amino acid sequence of SEQ ID NO:31).

In some embodiments, the anti-Tau antibody having one or more CDR sequences, heavy chain variable region sequences, and/or light chain variable region sequences as described herein recognizes an unphosphorylated epitope within residues 251-270 of SEQ ID NO:1. In some embodiments, the antibody recognizes a phosphorylated epitope within residues 251-270 of SEQ ID NO:1. In some embodiments, the antibody recognizes a phosphorylated epitope within residues 251-270 of SEQ ID NO:1 that is phosphorylated at residue Ser258. In some embodiments, the antibody recognizes a phosphorylated epitope within residues 251-270 of SEQ ID NO:1 that is phosphorylated at residue Ser262. In some embodiments, the antibody does not recognize a phosphorylated epitope within residues 251-270 that is phosphorylated at both residue Ser258 and residue Ser262.

In some embodiments, the anti-Tau antibody having one or more CDR sequences, heavy chain variable region sequences, and/or light chain variable region sequences as described herein recognizes an unphosphorylated epitope within residues 346-360 of SEQ ID NO:1. In some embodiments, the antibody does not recognize a phosphorylated epitope within residues 346-360 of SEQ ID NO:1.

1G7

In some embodiments, an anti-Tau antibody comprises a heavy chain CDR1 sequence comprising the amino acid sequence of SEQ ID NO:9, a heavy chain CDR2 sequence comprising the amino acid sequence of SEQ ID NO:10, and a heavy chain CDR3 sequence comprising the amino acid sequence of SEQ ID NO:33. In some embodiments, an anti-Tau antibody comprises a light chain CDR1 sequence comprising the amino acid sequence of SEQ ID NO:13, a light chain CDR2 sequence comprising the amino acid sequence of SEQ ID NO:14, and a light chain CDR3 sequence comprising the amino acid sequence of SEQ ID NO:20. In some embodiments, an anti-Tau antibody comprises a heavy chain CDR1-3 and a light chain CDR1-3 comprising the amino acid sequences of SEQ ID NOS:9, 10, 33, 13, 14, and 20, respectively.

In some embodiments, an anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:32. In some embodiments, an anti-Tau antibody comprises a heavy chain variable region comprising the amino acid sequence of SEQ ID NO:32.

In some embodiments, an anti-Tau antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:34. In some embodiments, an anti-Tau antibody comprises a light chain variable region comprising the amino acid sequence of SEQ ID NO:34.

In some embodiments, an anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:32 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:34. In some embodiments, an anti-Tau antibody comprises a heavy chain variable region comprising the amino acid sequence of SEQ ID NO:32 and further comprises a light chain variable region comprising the amino acid sequence of SEQ ID NO:34.

In some embodiments, an anti-Tau antibody is an antibody that competes for binding with an antibody as described herein (e.g., an antibody comprising a heavy chain CDR1-3 and a light chain CDR1-3 comprising the amino acid sequences of SEQ ID NOS:9, 10, 33, 13, 14, and 20, respectively, or an antibody comprising a heavy chain variable region comprising the amino acid sequence of SEQ ID NO:32 and further comprising a light chain variable region comprising the amino acid sequence of SEQ ID NO:34).

In some embodiments, the anti-Tau antibody having one or more CDR sequences, heavy chain variable region sequences, and/or light chain variable region sequences as described herein recognizes an unphosphorylated epitope within residues 251-270 of SEQ ID NO:1. In some embodiments, the antibody recognizes a phosphorylated epitope within residues 251-270 of SEQ ID NO:1. In some embodiments, the antibody recognizes a phosphorylated epitope within residues 251-270 of SEQ ID NO:1 that is phosphorylated at residue Ser258. In some embodiments, the antibody does not recognize a phosphorylated epitope within residues 251-270 of SEQ ID NO:1 that is phosphorylated at residue Ser262 or that is phosphorylated at both residue Ser258 and residue Ser262.

In some embodiments, the anti-Tau antibody having one or more CDR sequences, heavy chain variable region sequences, and/or light chain variable region sequences as described herein recognizes an unphosphorylated epitope within residues 346-360 of SEQ ID NO:1. In some embodiments, the antibody recognizes a phosphorylated epitope within residues 346-360 of SEQ ID NO:1. In some embodiments, the antibody recognizes a phosphorylated epitope within residues 346-360 of SEQ ID NO:1 that is phosphorylated at residue Ser352. In some embodiments, the antibody does not recognize a phosphorylated epitope within residues 346-360 of SEQ ID NO:1 that is phosphorylated at residue Ser356 or that is phosphorylated at both residue Ser352 and residue Ser356.

Anti-Tau Antibodies that Recognize an Epitope within Residues 186-205

In some embodiments, an anti-Tau antibody recognizes an epitope within residues 186-205 of SEQ ID NO:1 (e.g., an epitope comprising at least 6 contiguous amino acids within residues 186-205), or recognizes an epitope comprising or consisting of residues 186-205 of SEQ ID NO:1. In some embodiments, the anti-Tau antibody further comprises one or more complementarity determining region (CDR), heavy chain variable region, and/or light chain variable region sequences as described herein (e.g., as described in the Sequence Listing).

In some embodiments, an anti-Tau antibody specifically binds to a peptide having the sequence GEPPKSGDRSGYSSPGSPGT (SEQ ID NO:178), which corresponds to residues 186-205 of SEQ ID NO:1. In some embodiments, the peptide sequence set forth in SEQ ID NO:178 is sufficient for binding to the anti-Tau antibody. In some embodiments, the anti-Tau antibody further comprises one or more complementarity determining region (CDR), heavy chain variable region, and/or light chain variable region sequences as described herein (e.g., as described in the Sequence Listing).

In some embodiments, an anti-Tau antibody comprises one or more CDRs selected from the group consisting of:
(a) a heavy chain CDR1 having at least 90% sequence identity to the amino acid sequence of SEQ ID NO:168 or having up to two amino acid substitutions relative to the amino acid sequence of SEQ ID NO:168;
(b) a heavy chain CDR2 having at least 90% sequence identity to the amino acid sequence of SEQ ID NO:169 or having up to two amino acid substitutions relative to the amino acid sequence of SEQ ID NO:169;
(c) a heavy chain CDR3 having at least 90% sequence identity to the amino acid sequence of SEQ ID NO:170 or having up to two amino acid substitutions relative to the amino acid sequence of SEQ ID NO:170;
(d) a light chain CDR1 having at least 90% sequence identity to the amino acid sequence of SEQ ID NO:172 or having up to two amino acid substitutions relative to the amino acid sequence of SEQ ID NO:172;
(e) a light chain CDR2 having at least 90% sequence identity to the amino acid sequence of SEQ ID NO:173 or having up to two amino acid substitutions relative to the amino acid sequence of SEQ ID NO:173; and
(f) a light chain CDR3 having at least 90% sequence identity to the amino acid sequence of SEQ ID NO:174 or having up to two amino acid substitutions relative to the amino acid sequence of SEQ ID NO:174.

In some embodiments, an anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f). In some embodiments, a CDR having up to two amino acid substitutions has one amino acid substitution relative to the reference sequence. In some embodiments, a CDR having up to two amino acid substitutions has two amino acid substitutions relative to the reference sequence. In some embodiments, the up to two amino acid substitutions are conservative substitutions.

In some embodiments, an anti-Tau antibody comprises one or more CDRs selected from the group consisting of:
(a) a heavy chain CDR1 comprising the amino acid sequence of SEQ ID NO:168;
(b) a heavy chain CDR2 comprising the amino acid sequence of SEQ ID NO:169;
(c) a heavy chain CDR3 comprising the amino acid sequence of SEQ ID NOS:170;
(d) a light chain CDR1 comprising the amino acid sequence of SEQ ID NO:172;
(e) a light chain CDR2 comprising the amino acid sequence of SEQ ID NO:173; and
(f) a light chain CDR3 comprising the amino acid sequence of SEQ ID NO:174.

In some embodiments, an anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f).

In some embodiments, an anti-Tau antibody comprises one or more consensus sequences. Consensus sequences can be identified by aligning heavy chain or light chain sequences (e.g., CDRs) for antibodies that bind to the same or similar (e.g., overlapping) epitopes to determine conserved amino acids or motifs (i.e., where alteration in sequences may alter protein function) and regions where variation occurs in alignment of sequences (i.e., where variation of sequence is not likely to significantly affect protein function). In some embodiments, one or more consensus sequences can be identified for antibodies that recognize the same or similar epitope as 17G2.A1.

In some embodiments, an anti-Tau antibody binds to at least one of the following residues G186, E187, P188, P189, K190, S191, G192, D193, R194, S195, G196, Y197, S198, S199, P200, G201, S202, P203, G204, or T205 of SEQ ID NO:1. In some embodiments, an anti-Tau antibody binds to at least two, three, four, five, six, seven, eight, nine, ten, eleven, twelve, thirteen, fourteen, fifteen, sixteen, seventeen, eighteen, nineteen, or all twenty of the following residues G186, E187, P188, P189, K190, S191, G192, D193, R194, S195, G196, Y197, S198, S199, P200, G201, S202, P203, G204, or T205 of SEQ ID NO:1. In some embodiments, the anti-Tau antibody binds to contiguous residues of SEQ ID NO:1. In some embodiments, the anti-Tau antibody binds to non-contiguous residues of SEQ ID NO:1. In some embodiments, the anti-Tau antibody binds to both contiguous and non-contiguous residues of SEQ ID NO:1.

In some embodiments, an anti-Tau antibody binds to at least residue G186 of SEQ ID NO:1. In some embodiments, an anti-Tau antibody binds to at least residue E187 of SEQ ID NO:1. In some embodiments, an anti-Tau antibody binds to at least residue P188 of SEQ ID NO:1. In some embodiments, an anti-Tau antibody binds to at least residue P189 of SEQ ID NO:1. In some embodiments, an anti-Tau antibody binds to at least residue K190 of SEQ ID NO:1. In some embodiments, an anti-Tau antibody binds to at least residue S191 of SEQ ID NO:1. In some embodiments, an anti-Tau antibody binds to at least residue G192 of SEQ ID NO:1. In some embodiments, an anti-Tau antibody binds to at least residue D193 of SEQ ID NO:1. In some embodiments, an anti-Tau antibody binds to at least residue R194 of SEQ ID NO:1. In some embodiments, an anti-Tau antibody binds to at least residue S195 of SEQ ID NO:1. In some embodiments, an anti-Tau antibody binds to at least residue G196 of SEQ ID NO:1. In some embodiments, an anti-Tau antibody binds to at least residue Y197 of SEQ ID NO:1. In some embodiments, an anti-Tau antibody binds to at least residue S198 of SEQ ID NO:1. In some embodiments, an anti-Tau antibody binds to at least residue S199 of SEQ ID NO:1. In some embodiments, an anti-Tau antibody binds to at least residue P200 of SEQ ID NO:1. In some embodiments, an anti-Tau antibody binds to at least residue G201 of SEQ ID NO:1. In some embodiments, an anti-Tau antibody binds to at least residue 5202 of SEQ ID NO:1. In some embodiments, an anti-Tau antibody binds to at least residue P203 of SEQ ID NO:1. In some embodiments, an anti-Tau antibody binds to at least residue G204 of SEQ ID NO:1. In some embodiments, an anti-Tau antibody binds to at least residue T205 of SEQ ID NO:1.

In some embodiments, an anti-Tau antibody that recognizes an epitope within residues 186-205 of SEQ ID NO:1 prevents, reduces, or inhibits pathological Tau seeding and/or spreading, e.g., by at least 10%, 15%, 20%, 25%, 30%, 35%, 40%, 45%, 50%, 55%, 60%, 65%, 70%, 75%, 80%, 85%, 90%, or 95% (e.g., compared to the amount of pathological Tau seeding and/or spreading in the absence of the anti-Tau antibody). In some embodiments, an anti-Tau antibody that recognizes an epitope within residues 186-205 of SEQ ID NO:1 prevents, reduces, or inhibits Tau oligomerization, e.g., by at least 10%, 15%, 20%, 25%, 30%, 35%, 40%, 45%, 50%, 55%, 60%, 65%, 70%, 75%, 80%, 85%, 90%, or 95% (e.g., compared to the amount of Tau oligomerization in the absence of the anti-Tau antibody). In some embodiments, an anti-Tau antibody that recognizes an epitope within residues 186-205 of SEQ ID NO:1 prevents, reduces, or inhibits Tau aggregation, e.g., by at least 10%, 15%, 20%, 25%, 30%, 35%, 40%, 45%, 50%, 55%, 60%, 65%, 70%, 75%, 80%, 85%, 90%, or 95% (e.g., compared to the amount of Tau aggregation in the absence of the anti-Tau antibody). In some embodiments, an anti-Tau antibody that recognizes an epitope within residues 186-205 of SEQ ID NO:1 prevents, reduces, or inhibits the binding of another anti-Tau antibody, e.g., by at least 10%, 15%, 20%, 25%, 30%, 35%, 40%, 45%, 50%, 55%, 60%, 65%, 70%, 75%, 80%, 85%, 90%, or 95% (e.g., compared to antibody binding in the absence of the anti-Tau antibody that recognizes an epitope within residues 186-205 of SEQ ID NO:1). Methods for measuring Tau seeding, spreading, oligomerization, and/or aggregation are known in the art. A specific example of one such method for measuring Tau seeding and/or aggregation is described in Example 2.

17G2.A1

In some embodiments, an anti-Tau antibody comprises a heavy chain CDR1 sequence comprising the amino acid sequence of SEQ ID NO:168, a heavy chain CDR2 sequence comprising the amino acid sequence of SEQ ID NO:169, and a heavy chain CDR3 sequence comprising the amino acid sequence of SEQ ID NO:170. In some embodiments, an anti-Tau antibody comprises a light chain CDR1 sequence comprising the amino acid sequence of SEQ ID NO:172, a light chain CDR2 sequence comprising the amino acid sequence of SEQ ID NO:173, and a light chain CDR3 sequence comprising the amino acid sequence of SEQ ID NO:174. In some embodiments, an anti-Tau antibody comprises a heavy chain CDR1-3 and a light chain CDR1-3 comprising the amino acid sequences of SEQ ID NOS:168, 169, 170, 172, 173, and 174, respectively.

In some embodiments, an anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:167. In some embodiments, an anti-Tau antibody comprises a heavy chain variable region comprising the amino acid sequence of SEQ ID NO:167.

In some embodiments, an anti-Tau antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:171. In some embodiments, an anti-Tau antibody comprises a light chain variable region comprising the amino acid sequence of SEQ ID NO:171.

In some embodiments, an anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:167 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:171. In some embodiments, an anti-Tau antibody comprises a heavy chain variable region comprising the amino acid sequence of SEQ ID NO:167 and further comprises a light chain variable region comprising the amino acid sequence of SEQ ID NO:171.

In some embodiments, an anti-Tau antibody is an antibody that competes for binding with an antibody as described herein (e.g., an antibody comprising a heavy chain CDR1-3 and a light chain CDR1-3 comprising the amino acid sequences of SEQ ID NOS:168, 169, 170, 172, 173, and 174, respectively, or an antibody comprising a heavy chain variable region comprising the amino acid sequence of SEQ ID NO:167 and further comprising a light chain variable region comprising the amino acid sequence of SEQ ID NO:171).

Humanized and Affinity Matured Anti-Tau Antibodies from Murine Anti-Tau Antibody 1C7

In some embodiments, an anti-Tau antibody is a humanized antibody. Generally, a non-human antibody is humanized in order to reduce its immunogenicity. Humanized antibodies typically comprise one or more variable regions (e.g., CDRs) or portions thereof that are non-human (e.g., derived from a mouse variable region sequence), and possibly some framework regions or portions thereof that are non-human, and further comprise one or more constant regions that are derived from human antibody sequences. Methods for humanizing non-human antibodies are known in the art. Transgenic mice, or other organisms such as other mammals, can be used to express humanized or human antibodies.

Figure 3:
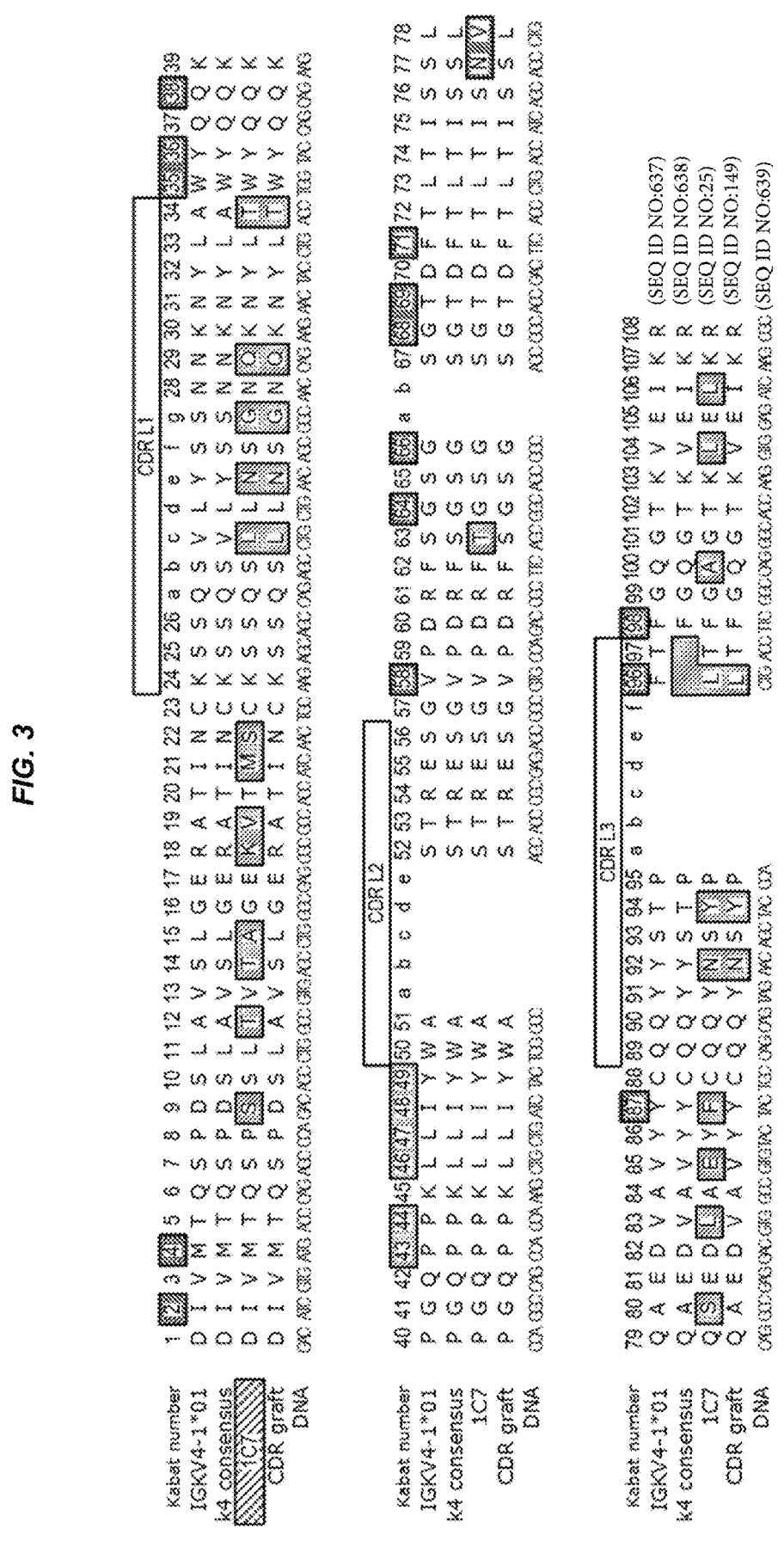
Figure 3:
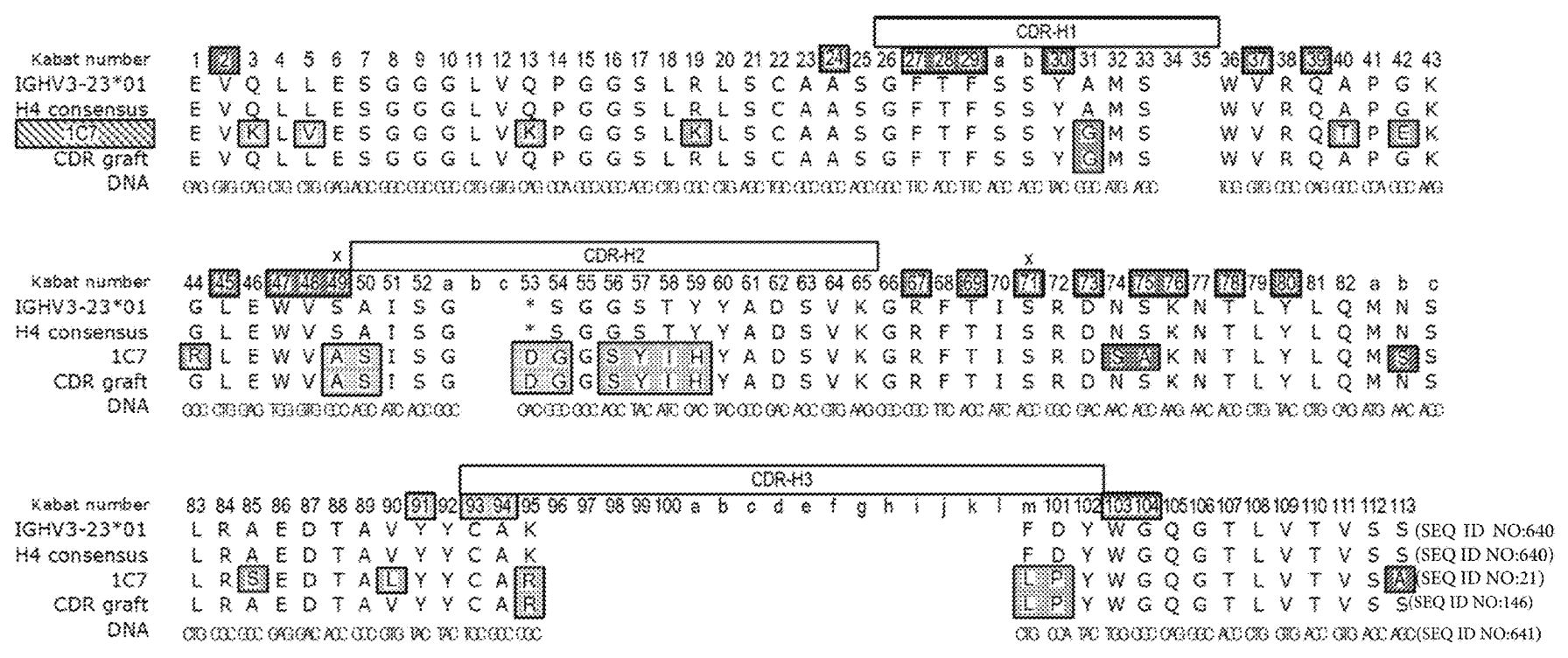

As described in Example 5, a humanized anti-Tau antibody was constructed by aligning the VL and VH regions from murine anti-Tau antibody 1C7 (mul C7) with the human VL kappa IV ($VL_{KIV}$) and human VH subgroup III ($VH_{III}$) consensus sequences (FIG. 3). Hypervariable regions (HVR) from the mu1C7 were engineered into $VL_{KIV}$ and $VH_{III}$ acceptor frameworks to generate a CDR-graft variant. From the mu1C7 VL region, positions 24-34 (L1), 50-56 (L2), and 89-97 (L3) were grafted into $VL_{KIV}$. From the mu1C7 VH region, positions 26-35 (H1), 50-65 (H2), and 93-102 (H3) were grafted into $VH_{III}$ (FIG. 3). To evaluate framework Vernier positions that might be important, selected Vernier positions S49 and S75 in VH were mutated back to the murine sequence to create humanized clones.

hu1C7.v1, hu1C7.v2, hu1C7.v3, hu1C7.v4, hu1C7.v2-1, and hu1C7.v2-2

In some embodiments, a humanized anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOS: 145-148. In some embodiments, an anti-Tau antibody comprises a heavy chain variable region comprising the amino acid sequence of any one of SEQ ID NOS:145-148.

In some embodiments, an anti-Tau antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:149. In some embodiments, an anti-Tau antibody comprises a light chain variable region comprising the amino acid sequence of SEQ ID NO:149.

In some embodiments, an anti-Tau antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:463. In some embodiments, an anti-Tau antibody comprises a light chain variable region comprising the amino acid sequence of SEQ ID NO:463.

In some embodiments, an anti-Tau antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:464. In some embodiments, an anti-Tau antibody comprises a light chain variable region comprising the amino acid sequence of SEQ ID NO:464.

In some embodiments, an anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOS:145-148 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:149. In some embodiments, an anti-Tau antibody comprises a heavy chain variable region comprising the amino acid sequence of any one of SEQ ID NOS:145-148 and further comprises a light chain variable region comprising the amino acid sequence of SEQ ID NO:149.

In some embodiments, an anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOS:145-148 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:463. In some embodiments, an anti-Tau antibody comprises a heavy chain variable region comprising the amino acid sequence of any one of SEQ ID NOS:145-148 and further comprises a light chain variable region comprising the amino acid sequence of SEQ ID NO:463.

In some embodiments, an anti-Tau antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOS:145-148 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:464. In some embodiments, an anti-Tau antibody comprises a heavy chain variable region comprising the amino acid sequence of any one of SEQ ID NOS:145-148 and further comprises a light chain variable region comprising the amino acid sequence of SEQ ID NO:464.

In some embodiments, phage libraries containing changes in hypervariable regions may be generated to improve the affinity of an anti-Tau antibody (see, e.g., Example 5). Phage selections may be performed to enrich for clones with high binding affinity. Selected clones may be subsequently sequenced and their binding affinities may be evaluated using Biacore™.

In some embodiments, an anti-Tau antibody comprises one or more CDRs selected from the group consisting of:
(a) a heavy chain CDR1 comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOS:22, 150-154, and 420-437;
(b) a heavy chain CDR2 comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOS:23 and 438-443;
(c) a heavy chain CDR3 comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOS:24 and 155;

(d) a light chain CDR1 comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOS:26, 156-158, and 444-459;

(e) a light chain CDR2 comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:27; and (f) a light chain CDR3 comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOS:28, 159-162, and 460-462.

In some embodiments, an affinity matured anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f).

In In some embodiments, an anti-Tau antibody comprises one or more CDRs selected from the group consisting of:

(a) a heavy chain CDR1 comprising the amino acid sequence of any one of SEQ ID NOS:22, 150-154, and 420-437;

(b) a heavy chain CDR2 comprising the amino acid sequence of any one of SEQ ID NOS:23 and 438-443;

(c) a heavy chain CDR3 comprising the amino acid sequence of any one of SEQ ID NOS:24 and 155;

(d) a light chain CDR1 comprising the amino acid sequence of any one of SEQ ID NOS:26, 156-158, and 444-459;

(e) a light chain CDR2 comprising the amino acid sequence of SEQ ID NO:27; and (f) a light chain CDR3 comprising the amino acid sequence of any one of SEQ ID NOS:28, 159-162, and 460-462.

In some embodiments, an affinity matured anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f).

In some embodiments, an affinity matured anti-Tau antibody comprises one or more CDRs selected from the group consisting of:

(a) a heavy chain CDR1 having up to six amino acid substitutions relative to the amino acid sequence of SEQ ID NO:22

(b) a heavy chain CDR2 having up to two amino acid substitutions relative to the amino acid sequence of SEQ ID NO:23;

(c) a heavy chain CDR3 having up to two amino acid substitutions relative to the amino acid sequence of SEQ ID NO:24;

(d) a light chain CDR1 having up to eight amino acid substitutions relative to the amino acid sequence of SEQ ID NO:26;

(e) a light chain CDR2 having up to two amino acid substitutions relative to the amino acid sequence of SEQ ID NO:27; and (f) a light chain CDR3 having up to three amino acid substitutions relative to the amino acid sequence of SEQ ID NO:28.

In some embodiments, an affinity matured anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f).

In some embodiments, an affinity matured anti-Tau antibody comprises one or more CDRs selected from the group consisting of:

(a) a heavy chain CDR1 having up to six amino acid substitutions relative to the amino acid sequence of SEQ ID NO:22

(b) a heavy chain CDR2 having up to two amino acid substitutions relative to the amino acid sequence of SEQ ID NO:23;

(c) a heavy chain CDR3 having up to two amino acid substitutions relative to the amino acid sequence of SEQ ID NO:24;

(d) a light chain CDR1 having up to eight amino acid substitutions relative to the amino acid sequence of SEQ ID NO:450;

(e) a light chain CDR2 having up to two amino acid substitutions relative to the amino acid sequence of SEQ ID NO:27; and (f) a light chain CDR3 having up to three amino acid substitutions relative to the amino acid sequence of SEQ ID NO:461.

In some embodiments, an affinity matured anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f).

In some embodiments, an affinity matured anti-Tau antibody comprises one or more CDRs selected from the group consisting of:

(a) a heavy chain CDR1 having up to six amino acid substitutions relative to the amino acid sequence of SEQ ID NO:22

(b) a heavy chain CDR2 having up to two amino acid substitutions relative to the amino acid sequence of SEQ ID NO:23;

(c) a heavy chain CDR3 having up to two amino acid substitutions relative to the amino acid sequence of SEQ ID NO:24;

(d) a light chain CDR1 having up to eight amino acid substitutions relative to the amino acid sequence of SEQ ID NO:459;

(e) a light chain CDR2 having up to two amino acid substitutions relative to the amino acid sequence of SEQ ID NO:27; and (f) a light chain CDR3 having up to three amino acid substitutions relative to the amino acid sequence of SEQ ID NO:461.

In some embodiments, an affinity matured anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f).

In some embodiments, an anti-Tau antibody comprises one or more CDRs selected from the group consisting of:
(a) a heavy chain CDR1 comprising the amino acid sequence of SEQ ID NO:163;
(b) a heavy chain CDR2 comprising the amino acid sequence of SEQ ID NO:23;
(c) a heavy chain CDR3 comprising the amino acid sequence of SEQ ID NOS:164;
(d) a light chain CDR1 comprising the amino acid sequence of SEQ ID NO:165;
(e) a light chain CDR2 comprising the amino acid sequence of SEQ ID NO:27; and
(f) a light chain CDR3 comprising the amino acid sequence of SEQ ID NO:166.

In some embodiments, an affinity matured anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f).

In some embodiments, an anti-Tau antibody comprises one or more CDRs selected from the group consisting of:
(a) a heavy chain CDR1 comprising the amino acid sequence of SEQ ID NO:465;
(b) a heavy chain CDR2 comprising the amino acid sequence of SEQ ID NO:466;
(c) a heavy chain CDR3 comprising the amino acid sequence of SEQ ID NOS:24;
(d) a light chain CDR1 comprising the amino acid sequence of SEQ ID NO:467;
(e) a light chain CDR2 comprising the amino acid sequence of SEQ ID NO:27; and
(f) a light chain CDR3 comprising the amino acid sequence of SEQ ID NO:468.

In some embodiments, an affinity matured anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f).

In some embodiments, an anti-Tau antibody comprises one or more CDRs selected from the group consisting of:
(a) a heavy chain CDR1 having at least 90% sequence identity to the amino acid sequence of SEQ ID NO:22 or having up to two amino acid substitutions relative to the amino acid sequence of SEQ ID NO:22;
(b) a heavy chain CDR2 having at least 90% sequence identity to the amino acid sequence of SEQ ID NO:23 or having up to two amino acid substitutions relative to the amino acid sequence of SEQ ID NO:23;
(c) a heavy chain CDR3 having at least 90% sequence identity to the amino acid sequence of SEQ ID NO:24 or having up to two amino acid substitutions relative to the amino acid sequence of SEQ ID NO:24;
(d) a light chain CDR1 having at least 90% sequence identity to the amino acid sequence of SEQ ID NO:450 or having up to two amino acid substitutions relative to the amino acid sequence of SEQ ID NO:450;
(e) a light chain CDR2 having at least 90% sequence identity to the amino acid sequence of SEQ ID NO:27 or having up to two amino acid substitutions relative to the amino acid sequence of SEQ ID NO:27; and
(f) a light chain CDR3 having at least 90% sequence identity to the amino acid sequence of SEQ ID NO:461 or having up to two amino acid substitutions relative to the amino acid sequence of SEQ ID NO:461.

In some embodiments, an anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f). In some embodiments, a CDR having up to two amino acid substitutions has one amino acid substitution relative to the reference sequence. In some embodiments, a CDR having up to two amino acid substitutions has two amino acid substitutions relative to the reference sequence. In some embodiments, the up to two amino acid substitutions are conservative substitutions.

In some embodiments, an anti-Tau antibody comprises one or more CDRs selected from the group consisting of:
(a) a heavy chain CDR1 comprising the amino acid sequence of SEQ ID NO:22;
(b) a heavy chain CDR2 comprising the amino acid sequence of SEQ ID NO:23;
(c) a heavy chain CDR3 comprising the amino acid sequence of SEQ ID NOS:24;
(d) a light chain CDR1 comprising the amino acid sequence of SEQ ID NO:450;
(e) a light chain CDR2 comprising the amino acid sequence of SEQ ID NO:27; and
(f) a light chain CDR3 comprising the amino acid sequence of SEQ ID NO:461.

In some embodiments, an anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f).

In some embodiments, an anti-Tau antibody comprises one or more CDRs selected from the group consisting of:
(a) a heavy chain CDR1 having at least 90% sequence identity to the amino acid sequence of SEQ ID NO:22 or having up to two amino acid substitutions relative to the amino acid sequence of SEQ ID NO:22;
(b) a heavy chain CDR2 having at least 90% sequence identity to the amino acid sequence of SEQ ID NO:23 or having up to two amino acid substitutions relative to the amino acid sequence of SEQ ID NO:23;
(c) a heavy chain CDR3 having at least 90% sequence identity to the amino acid sequence of SEQ ID NO:24 or having up to two amino acid substitutions relative to the amino acid sequence of SEQ ID NO:24;
(d) a light chain CDR1 having at least 90% sequence identity to the amino acid sequence of SEQ ID NO:459 or having up to two amino acid substitutions relative to the amino acid sequence of SEQ ID NO:459;
(e) a light chain CDR2 having at least 90% sequence identity to the amino acid sequence of SEQ ID NO:27 or having up to two amino acid substitutions relative to the amino acid sequence of SEQ ID NO:27; and
(f) a light chain CDR3 having at least 90% sequence identity to the amino acid sequence of SEQ ID NO:461 or having up to two amino acid substitutions relative to the amino acid sequence of SEQ ID NO:461.

In some embodiments, an anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f). In some embodiments, a CDR having up to two amino acid substitutions has one amino acid substitution relative to the reference sequence. In some embodiments, a CDR having up to two amino acid substitutions has two amino acid substitutions relative to the reference sequence. In some embodiments, the up to two amino acid substitutions are conservative substitutions.

In some embodiments, an anti-Tau antibody comprises one or more CDRs selected from the group consisting of:
  (a) a heavy chain CDR1 comprising the amino acid sequence of SEQ ID NO:22;
  (b) a heavy chain CDR2 comprising the amino acid sequence of SEQ ID NO:23;
  (c) a heavy chain CDR3 comprising the amino acid sequence of SEQ ID NOS:24;
  (d) a light chain CDR1 comprising the amino acid sequence of SEQ ID NO:459;
  (e) a light chain CDR2 comprising the amino acid sequence of SEQ ID NO:27; and
  (f) a light chain CDR3 comprising the amino acid sequence of SEQ ID NO:461.

In some embodiments, an anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f).

In some embodiments, an anti-Tau antibody comprises one or more CDRs selected from the group consisting of:
  (a) a heavy chain CDR1 having at least 90% sequence identity to the amino acid sequence of SEQ ID NO:150 or 151 or having up to two amino acid substitutions relative to the amino acid sequence of SEQ ID NO:150 or 151;
  (b) a heavy chain CDR2 having at least 90% sequence identity to the amino acid sequence of SEQ ID NO:23 or having up to two amino acid substitutions relative to the amino acid sequence of SEQ ID NO:23;
  (c) a heavy chain CDR3 having at least 90% sequence identity to the amino acid sequence of SEQ ID NO:155 or having up to two amino acid substitutions relative to the amino acid sequence of SEQ ID NO:155;
  (d) a light chain CDR1 having at least 90% sequence identity to the amino acid sequence of SEQ ID NO:450 or having up to two amino acid substitutions relative to the amino acid sequence of SEQ ID NO:450;
  (e) a light chain CDR2 having at least 90% sequence identity to the amino acid sequence of SEQ ID NO:27 or having up to two amino acid substitutions relative to the amino acid sequence of SEQ ID NO:27; and
  (f) a light chain CDR3 having at least 90% sequence identity to the amino acid sequence of SEQ ID NO:461 or having up to two amino acid substitutions relative to the amino acid sequence of SEQ ID NO:461.

In some embodiments, an anti-Tau antibody comprises one or more CDRs selected from the group consisting of:
  (a) a heavy chain CDR1 having the amino acid sequence of SEQ ID NO:150 or 151;
  (b) a heavy chain CDR2 having the amino acid sequence of SEQ ID NO:23;
  (c) a heavy chain CDR3 having the amino acid sequence of SEQ ID NO:155;
  (d) a light chain CDR1 having the amino acid sequence of SEQ ID NO:450;
  (e) a light chain CDR2 having the amino acid sequence of SEQ ID NO:27; and
  (f) a light chain CDR3 having the amino acid sequence of SEQ ID NO:461.

In some embodiments, an anti-Tau antibody comprises one or more CDRs selected from the group consisting of:
  (a) a heavy chain CDR1 having at least 90% sequence identity to the amino acid sequence of SEQ ID NO:150 or 151 or having up to two amino acid substitutions relative to the amino acid sequence of SEQ ID NO:150 or 151;
  (b) a heavy chain CDR2 having at least 90% sequence identity to the amino acid sequence of SEQ ID NO:23 or having up to two amino acid substitutions relative to the amino acid sequence of SEQ ID NO:23;
  (c) a heavy chain CDR3 having at least 90% sequence identity to the amino acid sequence of SEQ ID NO:155 or having up to two amino acid substitutions relative to the amino acid sequence of SEQ ID NO:155;
  (d) a light chain CDR1 having at least 90% sequence identity to the amino acid sequence of SEQ ID NO:459 or having up to two amino acid substitutions relative to the amino acid sequence of SEQ ID NO:459;
  (e) a light chain CDR2 having at least 90% sequence identity to the amino acid sequence of SEQ ID NO:27 or having up to two amino acid substitutions relative to the amino acid sequence of SEQ ID NO:27; and
  (f) a light chain CDR3 having at least 90% sequence identity to the amino acid sequence of SEQ ID NO:461 or having up to two amino acid substitutions relative to the amino acid sequence of SEQ ID NO:461.

In some embodiments, an anti-Tau antibody comprises one or more CDRs selected from the group consisting of:
  (a) a heavy chain CDR1 having the amino acid sequence of SEQ ID NO:150 or 151;
  (b) a heavy chain CDR2 having the amino acid sequence of SEQ ID NO:23;
  (c) a heavy chain CDR3 having the amino acid sequence of SEQ ID NO:155;
  (d) a light chain CDR1 having the amino acid sequence of SEQ ID NO:459;
  (e) a light chain CDR2 having the amino acid sequence of SEQ ID NO:27; and
  (f) a light chain CDR3 having the amino acid sequence of SEQ ID NO:461.

In some embodiments, an anti-Tau antibody comprises one or more CDRs selected from the group consisting of:
  (a) a heavy chain CDR1 having at least 90% sequence identity to the amino acid sequence of SEQ ID NO:153 or having up to two amino acid substitutions relative to the amino acid sequence of SEQ ID NO:153;
  (b) a heavy chain CDR2 having at least 90% sequence identity to the amino acid sequence of SEQ ID NO:23 or having up to two amino acid substitutions relative to the amino acid sequence of SEQ ID NO:23;
  (c) a heavy chain CDR3 having at least 90% sequence identity to the amino acid sequence of SEQ ID NO:24 or having up to two amino acid substitutions relative to the amino acid sequence of SEQ ID NO:24;
  (d) a light chain CDR1 having at least 90% sequence identity to the amino acid sequence of SEQ ID NO:158 or having up to two amino acid substitutions relative to the amino acid sequence of SEQ ID NO:158;
(e) a light chain CDR2 having at least 90% sequence identity to the amino acid sequence of SEQ ID NO:27 or having up to two amino acid substitutions relative to the amino acid sequence of SEQ ID NO:27; and
(f) a light chain CDR3 having at least 90% sequence identity to the amino acid sequence of SEQ ID NO:28 or having up to two amino acid substitutions relative to the amino acid sequence of SEQ ID NO:28.

In some embodiments, an anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f). In some embodiments, a CDR having up to two amino acid substitutions has one amino acid substitution relative to the reference sequence. In some embodiments, a CDR having up to two amino acid substitutions has two amino acid substitutions relative to the reference sequence. In some embodiments, the up to two amino acid substitutions are conservative substitutions.

In some embodiments, an anti-Tau antibody comprises one or more CDRs selected from the group consisting of:
(a) a heavy chain CDR1 comprising the amino acid sequence of SEQ ID NO:153;
(b) a heavy chain CDR2 comprising the amino acid sequence of SEQ ID NO:23;
(c) a heavy chain CDR3 comprising the amino acid sequence of SEQ ID NOS:24;
(d) a light chain CDR1 comprising the amino acid sequence of SEQ ID NO:158;
(e) a light chain CDR2 comprising the amino acid sequence of SEQ ID NO:27; and
(f) a light chain CDR3 comprising the amino acid sequence of SEQ ID NO:28.

In some embodiments, an anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f).

In some embodiments, an anti-Tau antibody comprises one or more CDRs selected from the group consisting of:
(a) a heavy chain CDR1 having at least 90% sequence identity to the amino acid sequence of SEQ ID NO:150 or having up to two amino acid substitutions relative to the amino acid sequence of SEQ ID NO:150;
(b) a heavy chain CDR2 having at least 90% sequence identity to the amino acid sequence of SEQ ID NO:23 or having up to two amino acid substitutions relative to the amino acid sequence of SEQ ID NO:23;
(c) a heavy chain CDR3 having at least 90% sequence identity to the amino acid sequence of SEQ ID NO:24 or having up to two amino acid substitutions relative to the amino acid sequence of SEQ ID NO:24;
(d) a light chain CDR1 having at least 90% sequence identity to the amino acid sequence of SEQ ID NO:158 or having up to two amino acid substitutions relative to the amino acid sequence of SEQ ID NO:158;
(e) a light chain CDR2 having at least 90% sequence identity to the amino acid sequence of SEQ ID NO:27 or having up to two amino acid substitutions relative to the amino acid sequence of SEQ ID NO:27; and
(f) a light chain CDR3 having at least 90% sequence identity to the amino acid sequence of SEQ ID NO:28 or having up to two amino acid substitutions relative to the amino acid sequence of SEQ ID NO:28.

In some embodiments, an anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f). In some embodiments, a CDR having up to two amino acid substitutions has one amino acid substitution relative to the reference sequence. In some embodiments, a CDR having up to two amino acid substitutions has two amino acid substitutions relative to the reference sequence. In some embodiments, the up to two amino acid substitutions are conservative substitutions.

In some embodiments, an anti-Tau antibody comprises one or more CDRs selected from the group consisting of:
(a) a heavy chain CDR1 comprising the amino acid sequence of SEQ ID NO:150;
(b) a heavy chain CDR2 comprising the amino acid sequence of SEQ ID NO:23;
(c) a heavy chain CDR3 comprising the amino acid sequence of SEQ ID NOS:24;
(d) a light chain CDR1 comprising the amino acid sequence of SEQ ID NO:158;
(e) a light chain CDR2 comprising the amino acid sequence of SEQ ID NO:27; and
(f) a light chain CDR3 comprising the amino acid sequence of SEQ ID NO:28.

In some embodiments, an anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f).

In some embodiments, an anti-Tau antibody comprises one or more CDRs selected from the group consisting of:
(a) a heavy chain CDR1 having at least 90% sequence identity to the amino acid sequence of SEQ ID NO:22 or having up to two amino acid substitutions relative to the amino acid sequence of SEQ ID NO:22;
(b) a heavy chain CDR2 having at least 90% sequence identity to the amino acid sequence of SEQ ID NO:23 or having up to two amino acid substitutions relative to the amino acid sequence of SEQ ID NO:23;
(c) a heavy chain CDR3 having at least 90% sequence identity to the amino acid sequence of SEQ ID NO:155 or having up to two amino acid substitutions relative to the amino acid sequence of SEQ ID NO:155;
(d) a light chain CDR1 having at least 90% sequence identity to the amino acid sequence of SEQ ID NO:158 or having up to two amino acid substitutions relative to the amino acid sequence of SEQ ID NO:158;
(e) a light chain CDR2 having at least 90% sequence identity to the amino acid sequence of SEQ ID NO:27 or having up to two amino acid substitutions relative to the amino acid sequence of SEQ ID NO:27; and
(f) a light chain CDR3 having at least 90% sequence identity to the amino acid sequence of SEQ ID NO:28 or having up to two amino acid substitutions relative to the amino acid sequence of SEQ ID NO:28.

In some embodiments, an anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f). In some embodiments, a CDR having up to two amino acid substitutions has one amino acid substitution relative to the reference sequence. In some embodiments, a CDR having up to two amino acid substitutions has two amino acid substitutions relative to the reference sequence. In some embodiments, the up to two amino acid substitutions are conservative substitutions.

In some embodiments, an anti-Tau antibody comprises one or more CDRs selected from the group consisting of:
- (a) a heavy chain CDR1 comprising the amino acid sequence of SEQ ID NO:22;
- (b) a heavy chain CDR2 comprising the amino acid sequence of SEQ ID NO:23;
- (c) a heavy chain CDR3 comprising the amino acid sequence of SEQ ID NOS:155;
- (d) a light chain CDR1 comprising the amino acid sequence of SEQ ID NO:158;
- (e) a light chain CDR2 comprising the amino acid sequence of SEQ ID NO:27; and
- (f) a light chain CDR3 comprising the amino acid sequence of SEQ ID NO:28.

In some embodiments, an anti-Tau antibody comprises two, three, four, five, or all six of (a)-(f). In some embodiments, an anti-Tau antibody comprises the heavy chain CDR1 of (a), the heavy chain CDR2 of (b), and the heavy chain CDR3 of (c). In some embodiments, an anti-Tau antibody comprises the light chain CDR1 of (d), the light chain CDR2 of (e), and the light chain CDR3 of (f).

In some embodiments, an anti-Tau antibody comprises a heavy chain CDR1 sequence comprising the amino acid sequence of SEQ ID NO:151, a heavy chain CDR2 sequence comprising the amino acid sequence of SEQ ID NO:588, and a heavy chain CDR3 sequence comprising the amino acid sequence of SEQ ID NO:24. In some embodiments, an anti-Tau antibody comprises a heavy chain variable region comprising heavy chain CDR1-3 sequences of SEQ ID NOS:151, 588, and 24, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:589. In some embodiments, an anti-Tau antibody comprises a heavy chain variable region comprising the amino acid sequence of SEQ ID NO:589.

In some embodiments, an anti-Tau antibody comprises a heavy chain CDR1 sequence comprising the amino acid sequence of SEQ ID NO:426, a heavy chain CDR2 sequence comprising the amino acid sequence of SEQ ID NO:588, and a heavy chain CDR3 sequence comprising the amino acid sequence of SEQ ID NO:24. In some embodiments, an anti-Tau antibody comprises a heavy chain variable region comprising heavy chain CDR1-3 sequences of SEQ ID NOS:426, 588, and 24, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:590. In some embodiments, an anti-Tau antibody comprises a heavy chain variable region comprising the amino acid sequence of SEQ ID NO:590.

In some embodiments, an anti-Tau antibody comprises a heavy chain CDR1 sequence comprising the amino acid sequence of SEQ ID NO:427, a heavy chain CDR2 sequence comprising the amino acid sequence of SEQ ID NO:588, and a heavy chain CDR3 sequence comprising the amino acid sequence of SEQ ID NO:24. In some embodiments, an anti-Tau antibody comprises a heavy chain variable region comprising heavy chain CDR1-3 sequences of SEQ ID NOS:427, 588, and 24, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:591. In some embodiments, an anti-Tau antibody comprises a heavy chain variable region comprising the amino acid sequence of SEQ ID NO:591.

In some embodiments, an anti-Tau antibody comprises a heavy chain CDR1 sequence comprising the amino acid sequence of SEQ ID NO:428, a heavy chain CDR2 sequence comprising the amino acid sequence of SEQ ID NO:588, and a heavy chain CDR3 sequence comprising the amino acid sequence of SEQ ID NO:24. In some embodiments, an anti-Tau antibody comprises a heavy chain variable region comprising heavy chain CDR1-3 sequences of SEQ ID NOS:428, 588, and 24, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:592. In some embodiments, an anti-Tau antibody comprises a heavy chain variable region comprising the amino acid sequence of SEQ ID NO:592.

In some embodiments, an anti-Tau antibody comprises a heavy chain CDR1 sequence comprising the amino acid sequence of SEQ ID NO:429, a heavy chain CDR2 sequence comprising the amino acid sequence of SEQ ID NO:588, and a heavy chain CDR3 sequence comprising the amino acid sequence of SEQ ID NO:24. In some embodiments, an anti-Tau antibody comprises a heavy chain variable region comprising heavy chain CDR1-3 sequences of SEQ ID NOS:429, 588, and 24, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:593. In some embodiments, an anti-Tau antibody comprises a heavy chain variable region comprising the amino acid sequence of SEQ ID NO:593.

In some embodiments, an anti-Tau antibody comprises a heavy chain CDR1 sequence comprising the amino acid sequence of SEQ ID NO:430, a heavy chain CDR2 sequence comprising the amino acid sequence of SEQ ID NO:588, and a heavy chain CDR3 sequence comprising the amino acid sequence of SEQ ID NO:24. In some embodiments, an anti-Tau antibody comprises a heavy chain variable region comprising heavy chain CDR1-3 sequences of SEQ ID NOS:430, 588, and 24, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:594. In some embodiments, an anti-Tau antibody comprises a heavy chain variable region comprising the amino acid sequence of SEQ ID NO:594.

In some embodiments, an anti-Tau antibody comprises a heavy chain CDR1 sequence comprising the amino acid sequence of SEQ ID NO:432, a heavy chain CDR2 sequence comprising the amino acid sequence of SEQ ID NO:588, and a heavy chain CDR3 sequence comprising the amino acid sequence of SEQ ID NO:24. In some embodiments, an anti-Tau antibody comprises a heavy chain variable region comprising heavy chain CDR1-3 sequences of SEQ ID NOS:432, 588, and 24, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:595. In some embodiments, an anti-Tau antibody comprises a heavy chain variable region comprising the amino acid sequence of SEQ ID NO:595.

In some embodiments, an anti-Tau antibody comprises a heavy chain CDR1 sequence comprising the amino acid sequence of SEQ ID NO:153, a heavy chain CDR2 sequence comprising the amino acid sequence of SEQ ID NO:588, and a heavy chain CDR3 sequence comprising the amino acid sequence of SEQ ID NO:24. In some embodiments, an anti-Tau antibody comprises a heavy chain variable region comprising heavy chain CDR1-3 sequences of SEQ ID NOS:153, 588, and 24, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:596. In some embodiments, an anti-Tau antibody comprises a heavy chain variable region comprising the amino acid sequence of SEQ ID NO:596.

In some embodiments, an anti-Tau antibody comprises a heavy chain CDR1 sequence comprising the amino acid sequence of SEQ ID NO:433, a heavy chain CDR2 sequence comprising the amino acid sequence of SEQ ID NO:588, and a heavy chain CDR3 sequence comprising the amino acid sequence of SEQ ID NO:24. In some embodiments, an anti-Tau antibody comprises a heavy chain variable region comprising heavy chain CDR1-3 sequences of SEQ ID NOS:433, 588, and 24, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:597. In some embodiments, an anti-Tau antibody comprises a heavy chain variable region comprising the amino acid sequence of SEQ ID NO:597.

In some embodiments, an anti-Tau antibody comprises a heavy chain CDR1 sequence comprising the amino acid sequence of SEQ ID NO:434, a heavy chain CDR2 sequence comprising the amino acid sequence of SEQ ID NO:588, and a heavy chain CDR3 sequence comprising the amino acid sequence of SEQ ID NO:24. In some embodiments, an anti-Tau antibody comprises a heavy chain variable region comprising heavy chain CDR1-3 sequences of SEQ ID NOS:434, 588, and 24, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:598. In some embodiments, an anti-Tau antibody comprises a heavy chain variable region comprising the amino acid sequence of SEQ ID NO:598.

In some embodiments, an anti-Tau antibody comprises a heavy chain CDR1 sequence comprising the amino acid sequence of SEQ ID NO:435, a heavy chain CDR2 sequence comprising the amino acid sequence of SEQ ID NO:588, and a heavy chain CDR3 sequence comprising the amino acid sequence of SEQ ID NO:24. In some embodiments, an anti-Tau antibody comprises a heavy chain variable region comprising heavy chain CDR1-3 sequences of SEQ ID NOS:435, 588, and 24, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:599. In some embodiments, an anti-Tau antibody comprises a heavy chain variable region comprising the amino acid sequence of SEQ ID NO:599.

In some embodiments, an anti-Tau antibody comprises a heavy chain CDR1 sequence comprising the amino acid sequence of SEQ ID NO:436, a heavy chain CDR2 sequence comprising the amino acid sequence of SEQ ID NO:588, and a heavy chain CDR3 sequence comprising the amino acid sequence of SEQ ID NO:24. In some embodiments, an anti-Tau antibody comprises a heavy chain variable region comprising heavy chain CDR1-3 sequences of SEQ ID NOS:436, 588, and 24, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:600. In some embodiments, an anti-Tau antibody comprises a heavy chain variable region comprising the amino acid sequence of SEQ ID NO:600.

In some embodiments, an anti-Tau antibody comprises a heavy chain CDR1 sequence comprising the amino acid sequence of SEQ ID NO:437, a heavy chain CDR2 sequence comprising the amino acid sequence of SEQ ID NO:588, and a heavy chain CDR3 sequence comprising the amino acid sequence of SEQ ID NO:24. In some embodiments, an anti-Tau antibody comprises a heavy chain variable region comprising heavy chain CDR1-3 sequences of SEQ ID NOS:437, 588, and 24, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:601. In some embodiments, an anti-Tau antibody comprises a heavy chain variable region comprising the amino acid sequence of SEQ ID NO:601.

In some embodiments, an anti-Tau antibody comprises a heavy chain CDR1 sequence comprising the amino acid sequence of SEQ ID NO:586, a heavy chain CDR2 sequence comprising the amino acid sequence of SEQ ID NO:588, and a heavy chain CDR3 sequence comprising the amino acid sequence of SEQ ID NO:24. In some embodiments, an anti-Tau antibody comprises a heavy chain variable region comprising heavy chain CDR1-3 sequences of SEQ ID NOS:586, 588, and 24, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:602. In some embodiments, an anti-Tau antibody comprises a heavy chain variable region comprising the amino acid sequence of SEQ ID NO:602.

In some embodiments, an anti-Tau antibody comprises a heavy chain CDR1 sequence comprising the amino acid sequence of SEQ ID NO:587, a heavy chain CDR2 sequence comprising the amino acid sequence of SEQ ID NO:588, and a heavy chain CDR3 sequence comprising the amino acid sequence of SEQ ID NO:24. In some embodiments, an anti-Tau antibody comprises a heavy chain variable region comprising heavy chain CDR1-3 sequences of SEQ ID NOS:587, 588, and 24, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:603. In some embodiments, an anti-Tau antibody comprises a heavy chain variable region comprising the amino acid sequence of SEQ ID NO:603.

In some embodiments, an anti-Tau antibody comprises a light chain CDR1 sequence comprising the amino acid sequence of SEQ ID NO:158, a light chain CDR2 sequence comprising the amino acid sequence of SEQ ID NO:27, and a light chain CDR3 sequence comprising the amino acid sequence of SEQ ID NO:28. In some embodiments, an anti-Tau antibody comprises a light chain variable region comprising light chain CDR1-3 sequences of SEQ ID NOS: 158, 27, and 28, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:604. In some embodiments, an anti-Tau antibody comprises a light chain variable region comprising the amino acid sequence of SEQ ID NO:604.

In some embodiments, an anti-Tau antibody comprises a light chain CDR1 sequence comprising the amino acid sequence of SEQ ID NO:448, a light chain CDR2 sequence comprising the amino acid sequence of SEQ ID NO:27, and a light chain CDR3 sequence comprising the amino acid sequence of SEQ ID NO:28. In some embodiments, an anti-Tau antibody comprises a light chain variable region comprising light chain CDR1-3 sequences of SEQ ID NOS: 448, 27, and 28, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:605. In some embodiments, an anti-Tau antibody comprises a light chain variable region comprising the amino acid sequence of SEQ ID NO:605.

In some embodiments, an anti-Tau antibody comprises a light chain CDR1 sequence comprising the amino acid sequence of SEQ ID NO:449, a light chain CDR2 sequence comprising the amino acid sequence of SEQ ID NO:27, and a light chain CDR3 sequence comprising the amino acid sequence of SEQ ID NO:28. In some embodiments, an anti-Tau antibody comprises a light chain variable region comprising light chain CDR1-3 sequences of SEQ ID NOS: 449, 27, and 28, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:606. In some embodiments, an anti-Tau antibody comprises a light chain variable region comprising the amino acid sequence of SEQ ID NO:606.

In some embodiments, an anti-Tau antibody comprises a light chain CDR1 sequence comprising the amino acid sequence of SEQ ID NO:450, a light chain CDR2 sequence comprising the amino acid sequence of SEQ ID NO:27, and a light chain CDR3 sequence comprising the amino acid sequence of SEQ ID NO:28. In some embodiments, an anti-Tau antibody comprises a light chain variable region comprising light chain CDR1-3 sequences of SEQ ID NOS: 450, 27, and 28, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:607. In some embodiments, an anti-Tau antibody comprises a light chain variable region comprising the amino acid sequence of SEQ ID NO:607.

In some embodiments, an anti-Tau antibody comprises a light chain CDR1 sequence comprising the amino acid sequence of SEQ ID NO:451, a light chain CDR2 sequence comprising the amino acid sequence of SEQ ID NO:27, and a light chain CDR3 sequence comprising the amino acid sequence of SEQ ID NO:28. In some embodiments, an anti-Tau antibody comprises a light chain variable region comprising light chain CDR1-3 sequences of SEQ ID NOS: 451, 27, and 28, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:608. In some embodiments, an anti-Tau antibody comprises a light chain variable region comprising the amino acid sequence of SEQ ID NO:608.

In some embodiments, an anti-Tau antibody comprises a light chain CDR1 sequence comprising the amino acid sequence of SEQ ID NO:452, a light chain CDR2 sequence comprising the amino acid sequence of SEQ ID NO:27, and a light chain CDR3 sequence comprising the amino acid sequence of SEQ ID NO:28. In some embodiments, an anti-Tau antibody comprises a light chain variable region comprising light chain CDR1-3 sequences of SEQ ID NOS: 452, 27, and 28, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:609. In some embodiments, an anti-Tau antibody comprises a light chain variable region comprising the amino acid sequence of SEQ ID NO:609.

In some embodiments, an anti-Tau antibody comprises a light chain CDR1 sequence comprising the amino acid sequence of SEQ ID NO:453, a light chain CDR2 sequence comprising the amino acid sequence of SEQ ID NO:27, and a light chain CDR3 sequence comprising the amino acid sequence of SEQ ID NO:28. In some embodiments, an anti-Tau antibody comprises a light chain variable region comprising light chain CDR1-3 sequences of SEQ ID NOS: 453, 27, and 28, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:610. In some embodiments, an anti-Tau antibody comprises a light chain variable region comprising the amino acid sequence of SEQ ID NO:610.

In some embodiments, an anti-Tau antibody comprises a light chain CDR1 sequence comprising the amino acid sequence of SEQ ID NO:454, a light chain CDR2 sequence comprising the amino acid sequence of SEQ ID NO:27, and a light chain CDR3 sequence comprising the amino acid sequence of SEQ ID NO:28. In some embodiments, an anti-Tau antibody comprises a light chain variable region comprising light chain CDR1-3 sequences of SEQ ID NOS: 454, 27, and 28, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:611. In some embodiments, an anti-Tau antibody comprises a light chain variable region comprising the amino acid sequence of SEQ ID NO:611.

In some embodiments, an anti-Tau antibody comprises a light chain CDR1 sequence comprising the amino acid sequence of SEQ ID NO:455, a light chain CDR2 sequence comprising the amino acid sequence of SEQ ID NO:27, and a light chain CDR3 sequence comprising the amino acid sequence of SEQ ID NO:28. In some embodiments, an anti-Tau antibody comprises a light chain variable region comprising light chain CDR1-3 sequences of SEQ ID NOS: 455, 27, and 28, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:612. In some embodiments, an anti-Tau antibody comprises a light chain variable region comprising the amino acid sequence of SEQ ID NO:612.

In some embodiments, an anti-Tau antibody comprises a light chain CDR1 sequence comprising the amino acid sequence of SEQ ID NO:456, a light chain CDR2 sequence comprising the amino acid sequence of SEQ ID NO:27, and a light chain CDR3 sequence comprising the amino acid sequence of SEQ ID NO:28. In some embodiments, an anti-Tau antibody comprises a light chain variable region comprising light chain CDR1-3 sequences of SEQ ID NOS: 456, 27, and 28, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:613. In some embodiments, an anti-Tau antibody comprises a light chain variable region comprising the amino acid sequence of SEQ ID NO:613.

In some embodiments, an anti-Tau antibody comprises a light chain CDR1 sequence comprising the amino acid sequence of SEQ ID NO:457, a light chain CDR2 sequence comprising the amino acid sequence of SEQ ID NO:27, and a light chain CDR3 sequence comprising the amino acid sequence of SEQ ID NO:28. In some embodiments, an anti-Tau antibody comprises a light chain variable region comprising light chain CDR1-3 sequences of SEQ ID NOS: 457, 27, and 28, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:614. In some embodiments, an anti-Tau antibody comprises a light chain variable region comprising the amino acid sequence of SEQ ID NO:614.

In some embodiments, an anti-Tau antibody comprises a light chain CDR1 sequence comprising the amino acid sequence of SEQ ID NO:458, a light chain CDR2 sequence comprising the amino acid sequence of SEQ ID NO:27, and a light chain CDR3 sequence comprising the amino acid sequence of SEQ ID NO:28. In some embodiments, an anti-Tau antibody comprises a light chain variable region comprising light chain CDR1-3 sequences of SEQ ID NOS: 458, 27, and 28, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:615. In some embodiments, an anti-Tau antibody comprises a light chain variable region comprising the amino acid sequence of SEQ ID NO:615.

In some embodiments, an anti-Tau antibody comprises a light chain CDR1 sequence comprising the amino acid sequence of SEQ ID NO:158, a light chain CDR2 sequence comprising the amino acid sequence of SEQ ID NO:27, and a light chain CDR3 sequence comprising the amino acid sequence of SEQ ID NO:461. In some embodiments, an anti-Tau antibody comprises a light chain variable region comprising light chain CDR1-3 sequences of SEQ ID NOS: 158, 27, and 461, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:616. In some embodiments, an anti-Tau antibody comprises a light chain variable region comprising the amino acid sequence of SEQ ID NO:616.

In some embodiments, an anti-Tau antibody comprises a light chain CDR1 sequence comprising the amino acid sequence of SEQ ID NO:450, a light chain CDR2 sequence comprising the amino acid sequence of SEQ ID NO:27, and a light chain CDR3 sequence comprising the amino acid sequence of SEQ ID NO:461. In some embodiments, an anti-Tau antibody comprises a light chain variable region comprising light chain CDR1-3 sequences of SEQ ID NOS: 450, 27, and 461, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:463. In some embodiments, an anti-Tau antibody comprises a light chain variable region comprising the amino acid sequence of SEQ ID NO:463.

An anti-Tau antibody may comprise one or more CDRs selected from the group consisting of:
(a) a heavy chain CDR1 comprising the amino acid sequence of SEQ ID NO:586;
(b) a heavy chain CDR2 comprising the amino acid sequence of SEQ ID NO:588;
(c) a heavy chain CDR3 comprising the amino acid sequence of SEQ ID NOS:24;
(d) a light chain CDR1 comprising the amino acid sequence of SEQ ID NO:158;
(e) a light chain CDR2 comprising the amino acid sequence of SEQ ID NO:27; and
(f) a light chain CDR3 comprising the amino acid sequence of SEQ ID NO:28.

An anti-Tau antibody may comprise a heavy chain variable region comprising heavy chain CDR1-3 sequences of SEQ ID NOS:586, 588, and 24, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to the sequence of SEQ ID NO:602 and further comprise a light chain variable region comprising light chain CDR1-3 sequences of SEQ ID NOS:158, 27, and 28, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to the sequence of SEQ ID NO:604. In some embodiments, an anti-Tau antibody comprises a heavy chain variable region comprising the amino acid sequence of SEQ ID NO:602 and further comprises a light chain variable region comprising the amino acid sequence of SEQ ID NO:604.

An anti-Tau antibody may comprise one or more CDRs selected from the group consisting of:
(a) a heavy chain CDR1 comprising the amino acid sequence of SEQ ID NO:586;
(b) a heavy chain CDR2 comprising the amino acid sequence of SEQ ID NO:588;
(c) a heavy chain CDR3 comprising the amino acid sequence of SEQ ID NOS:24;
(d) a light chain CDR1 comprising the amino acid sequence of SEQ ID NO:158;
(e) a light chain CDR2 comprising the amino acid sequence of SEQ ID NO:27; and
(f) a light chain CDR3 comprising the amino acid sequence of SEQ ID NO:461.

An anti-Tau antibody may comprise a heavy chain variable region comprising heavy chain CDR1-3 sequences of SEQ ID NOS:586, 588, and 24, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to the sequence of SEQ ID NO:602 and further comprise a light chain variable region comprising light chain CDR1-3 sequences of SEQ ID NOS:158, 27, and 461, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to the sequence of SEQ ID NO:616. In some embodiments, an anti-Tau antibody comprises a heavy chain variable region comprising the amino acid sequence of SEQ ID NO:602 and further comprises a light chain variable region comprising the amino acid sequence of SEQ ID NO:616.

An anti-Tau antibody may comprise one or more CDRs selected from the group consisting of:
(a) a heavy chain CDR1 comprising the amino acid sequence of SEQ ID NO:586;
(b) a heavy chain CDR2 comprising the amino acid sequence of SEQ ID NO:588;
(c) a heavy chain CDR3 comprising the amino acid sequence of SEQ ID NOS:24;
(d) a light chain CDR1 comprising the amino acid sequence of SEQ ID NO:450;
(e) a light chain CDR2 comprising the amino acid sequence of SEQ ID NO:27; and
(f) a light chain CDR3 comprising the amino acid sequence of SEQ ID NO:461.

An anti-Tau antibody may comprise a heavy chain variable region comprising heavy chain CDR1-3 sequences of SEQ ID NOS:586, 588, and 24, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to the sequence of SEQ ID NO:602 and further comprise a light chain variable region comprising light chain CDR1-3 sequences of SEQ ID NOS:450, 27, and 461, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to the sequence of SEQ ID NO:463. In some embodiments, an anti-Tau antibody comprises a heavy chain variable region comprising the amino acid sequence of SEQ ID NO:602 and further comprises a light chain variable region comprising the amino acid sequence of SEQ ID NO:463.

An anti-Tau antibody may comprise one or more CDRs selected from the group consisting of:
(a) a heavy chain CDR1 comprising the amino acid sequence of SEQ ID NO:587;
(b) a heavy chain CDR2 comprising the amino acid sequence of SEQ ID NO:588;
(c) a heavy chain CDR3 comprising the amino acid sequence of SEQ ID NOS:24;
(d) a light chain CDR1 comprising the amino acid sequence of SEQ ID NO:158;
(e) a light chain CDR2 comprising the amino acid sequence of SEQ ID NO:27; and
(f) a light chain CDR3 comprising the amino acid sequence of SEQ ID NO:28.

An anti-Tau antibody may comprise a heavy chain variable region comprising heavy chain CDR1-3 sequences of SEQ ID NOS:587, 588, and 24, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to the sequence of SEQ ID NO:603 and further comprise a light chain variable region comprising light chain CDR1-3 sequences of SEQ ID NOS:158, 27, and 28, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to the sequence of SEQ ID NO:604. In some embodiments, an anti-Tau antibody comprises a heavy chain variable region comprising the amino acid sequence of SEQ ID NO:603 and further comprises a light chain variable region comprising the amino acid sequence of SEQ ID NO:604.

An anti-Tau antibody may comprise one or more CDRs selected from the group consisting of:
(a) a heavy chain CDR1 comprising the amino acid sequence of SEQ ID NO:587;
(b) a heavy chain CDR2 comprising the amino acid sequence of SEQ ID NO:588;
(c) a heavy chain CDR3 comprising the amino acid sequence of SEQ ID NOS:24;
(d) a light chain CDR1 comprising the amino acid sequence of SEQ ID NO:158;
(e) a light chain CDR2 comprising the amino acid sequence of SEQ ID NO:27; and
(f) a light chain CDR3 comprising the amino acid sequence of SEQ ID NO:461.

An anti-Tau antibody may comprise a heavy chain variable region comprising heavy chain CDR1-3 sequences of SEQ ID NOS:587, 588, and 24, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to the sequence of SEQ ID NO:603 and further comprise a light chain variable region comprising light chain CDR1-3 sequences of SEQ ID NOS:158, 27, and 461, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to the sequence of SEQ ID NO:616. In some embodiments, an anti-Tau antibody comprises a heavy chain variable region comprising the amino acid sequence of SEQ ID NO:603 and further comprises a light chain variable region comprising the amino acid sequence of SEQ ID NO:616.

An anti-Tau antibody may comprise one or more CDRs selected from the group consisting of:
(a) a heavy chain CDR1 comprising the amino acid sequence of SEQ ID NO:587;
(b) a heavy chain CDR2 comprising the amino acid sequence of SEQ ID NO:588;
(c) a heavy chain CDR3 comprising the amino acid sequence of SEQ ID NOS:24;
(d) a light chain CDR1 comprising the amino acid sequence of SEQ ID NO:450;
(e) a light chain CDR2 comprising the amino acid sequence of SEQ ID NO:27; and
(f) a light chain CDR3 comprising the amino acid sequence of SEQ ID NO:461.

An anti-Tau antibody may comprise a heavy chain variable region comprising heavy chain CDR1-3 sequences of SEQ ID NOS:587, 588, and 24, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to the sequence of SEQ ID NO:603 and further comprise a light chain variable region comprising light chain CDR1-3 sequences of SEQ ID NOS:450, 27, and 461, respectively, and an amino acid sequence that has at least 90% sequence identity (e.g., at least 91%, at least 92%, at least 93%, at least 94%, at least 95%, at least 96%, at least 97%, at least 98%, or at least 99% sequence identity) to the sequence of SEQ ID NO:463. In some embodiments, an anti-Tau antibody comprises a heavy chain variable region comprising the amino acid sequence of SEQ ID NO:603 and further comprises a light chain variable region comprising the amino acid sequence of SEQ ID NO:463.

In some embodiments, an anti-Tau antibody comprises one or more consensus sequences. Consensus sequences can be identified by aligning heavy chain or light chain sequences (e.g., CDRs) for antibodies that bind to the same or similar (e.g., overlapping) epitopes to determine conserved amino acids or motifs (i.e., where alteration in sequences may alter protein function) and regions where variation occurs in alignment of sequences (i.e., where variation of sequence is not likely to significantly affect protein function). In some embodiments, one or more consensus sequences can be identified for antibodies that recognize the same or similar epitope as 1C7. Exemplary hu1C7.v2-like consensus sequences include SEQ ID NOS: 163-166 and 465-468. In the consensus sequences of SEQ ID NOS:163-166, 465-468, and 617-624, each "X" represents an amino acid residue that is not absolutely conserved among the aligned sequences (e.g., aligned CDR sequences). It will be appreciated that when selecting an amino acid to insert at a position marked by an "X" that in some embodiments, the amino acid is selected from those amino acids found at the corresponding position in the aligned sequences.

In some embodiments, the antibody comprises a heavy chain CDR1 sequence having the consensus sequence $X_1X_2X_3X_4X_5X_6X_7GX_8S$ (SEQ ID NO:163), wherein $X_1$ is G or V; $X_2$ is F or I; $X_3$ is T, K, or R; $X_4$ is F or W; $X_5$ is S or R; $X_6$ is S, R, G, or I; $X_7$ is Y, V, or P; and $X_8$ is M, V, or T. In some embodiments, the heavy chain CDR1 consensus sequence comprises the sequence GFTFSSYGMS (SEQ ID NO:22); GFKFSRVGVS (SEQ ID NO:150); GFTFSRVGTS (SEQ ID NO:151); GFRFSRVGMS (SEQ ID NO:152); GFRFSGPGMS (SEQ ID NO:153); or VIKWRIYGMS (SEQ ID NO:154).

In some embodiments, the antibody comprises a heavy chain CDR1 sequence having the consensus sequence GFX$_1$FSX$_2$X$_3$GX$_4$S (SEQ ID NO:465), wherein $X_1$ is T, K, R, Q, or M; $X_2$ is S, R, Q, M, L, K, G, or, S; $X_3$ is Y, V, or P; and $X_4$ is M, V, or T. In some embodiments, the antibody comprises a heavy chain CDR1 sequence having the consensus sequence $X_1X_2X_3X_4X_5X_6X_7GX_8S$ (SEQ ID NO:617), wherein $X_1$ is G or V; $X_2$ is F or I; $X_3$ is T, K, R, Q, or M; $X_4$ is F or W; $X_5$ is S or R; $X_6$ is S, R, G, I, Q, M, L, or K; $X_7$ is Y, V, or P; and $X_8$ is M, V, or T. In some embodiments, the antibody comprises a heavy chain CDR1 sequence having the consensus sequence $X_1X_2X_3X_4X_5X_6X_7X_8X_9X_{10}$ (SEQ ID NO:620), wherein $X_1$ is G, V, or R; $X_2$ is F or I; $X_3$ is T, K, R, Q, M, or N; $X_4$ is F, W, or I; $X_5$ is S, R, E, or K; $X_6$ is S, R, G, I, Q, M, L, K, or D; $X_7$ is Y, V, P, or D; $X_8$ is G or Y; $X_9$ is M, V, or T; and $X_{10}$ is S or H. In some embodiments, the heavy chain CDR1 consensus sequence comprises the sequence of any one of SEQ ID NOS:22, 150-154, 420-437, 586, and 587.

In some embodiments, the antibody comprises a heavy chain CDR2 sequence having the consensus sequence SISGX$_1$X$_2$GSYIHYAX$_3$X$_4$VK (SEQ ID NO:466), wherein $X_1$ is D, E, T, or S; $X_2$ is G or A; and $X_3$ is D or S; $X_4$ is S or A. In some embodiments, the antibody comprises a heavy chain CDR2 sequence having the consensus sequence SISGX$_1$X$_2$GSYIX$_3$YAX$_4$X$_5$VK (SEQ ID NO:621), wherein $X_1$ is D, E, T, or S; $X_2$ is G or A; $X_3$ is H or R; $X_4$ is D or S; and $X_5$ is S or A. In some embodiments, the heavy chain CDR2 consensus sequence comprises the sequence of any one of SEQ ID NOS:23 and 438-443.

In some embodiments, the antibody comprises a heavy chain CDR3 sequence having the consensus sequence AX$_1$LPX$_2$ (SEQ ID NO:164), wherein $X_1$ is R or K; and $X_2$ is Y or F. In some embodiments, the antibody comprises a heavy chain CDR3 sequence having the consensus sequence $X_1X_2LX_3X_4$ (SEQ ID NO:622), wherein $X_1$ is A, T, or N; $X_2$ is R, K, or T; $X_3$ is P or R; and $X_4$ is Y or F. In some embodiments, the heavy chain CDR3 consensus sequence comprises the sequence ARLPY (SEQ ID NO:24) or AKLPF (SEQ ID NO:155).

In some embodiments, the antibody comprises a light chain CDR1 sequence having the consensus sequence KSSX$_1$SLX$_2$X$_3$SX$_4$X$_5$X$_6$X$_7$X$_8$YLX$_9$ (SEQ ID NO:165), wherein $X_1$ is Q or H; $X_2$ is L, Y, or H; $X_3$ is N, S, or R; $X_4$ is G or R; $X_5$ is N, R, K, or T; $X_6$ is Q, H, or R; $X_7$ is K or Q; $X_8$ is N, H, or D; and $X_9$ is N, T, V. In some embodiments, the light chain CDR1 consensus sequence comprises the sequence KSSQSLLNSGNQKNYLT (SEQ ID NO:26), KSSHSLYSSRRHKHYLA (SEQ ID NO:156), KSSQSLLRSGKRQNYLV (SEQ ID NO:157), or KSSQSLHRSGTQKDYLV (SEQ ID NO:158).

In some embodiments, the antibody comprises a light chain CDR1 sequence having the consensus sequence KSSQSLX$_1$X$_2$X$_3$GX$_4$QKX$_5$YLX$_6$ (SEQ ID NO:467), wherein $X_1$ is L, H, or V; $X_2$ is N, Y, S, Q, R, M, K, or L; $X_3$ is S or A; $X_4$ is T or N; $X_5$ is N or D; $X_6$ is T, V, or A. In some embodiments, the antibody comprises a light chain CDR1 sequence having the consensus sequence KSSX$_1$SLX$_2$X$_3$X$_4$X$_5$X$_6$X$_7$X$_8$X$_9$YLX$_{10}$ (SEQ ID NO:618), wherein $X_1$ is Q or H; $X_2$ is L, Y, H, or V; $X_3$ is N, S, R, Y, Q, M, K, or L; $X_4$ is S or A; $X_5$ is G or R; $X_6$ is N, R, K, or T; $X_7$ is Q, H, or R; $X_8$ is K or Q; $X_9$ is N, H, or D; and $X_{10}$ is T, A, or V. In some embodiments, the light chain CDR1 consensus sequence comprises the sequence of SEQ ID NOS:444-459.

In some embodiments, the antibody comprises a light chain CDR2 sequence having the consensus sequence $X_1X_2SX_3X_4X_5X_6$ (SEQ ID NO:623), wherein $X_1$ is S, W, R, or L; $X_2$ is A, M, or V; $X_3$ is Y, T, F, N, or K; $X_4$ is R, L, or K; $X_5$ is Y, H, A, or E; and $X_6$ is S or T.

In some embodiments, the antibody comprises a light chain CDR3 sequence having the consensus sequence QX$_1$YX$_2$X$_3$YPX$_4$T (SEQ ID NO:166), wherein $X_1$ is Q, K, or H; $X_2$ is N, D, or R; $X_3$ is S or T; and $X_4$ is L or M. In some embodiments, the light chain CDR3 consensus sequence comprises the sequence QQYNSYPLT (SEQ ID NO:28), QKYNSYPLT (SEQ ID NO:159), QKYDSYPLT (SEQ ID NO:160), QHYRTYPLT (SEQ ID NO:161), or QHYRSYPMT (SEQ ID NO:162).

In some embodiments, the antibody comprises a light chain CDR3 sequence having the consensus sequence QQYX$_1$X$_2$YPLT (SEQ ID NO:468), wherein $X_1$ is N, Y, or S; $X_2$ is S or A. In some embodiments, the antibody comprises a light chain CDR3 sequence having the consensus sequence QX$_1$YX$_2$X$_3$YPX$_4$T (SEQ ID NO:619), wherein $X_1$ is Q, K, or H; $X_2$ is N, D, R, Y, or S; $X_3$ is S, T, or A; and $X_4$ is L or M. In some embodiments, the antibody comprises a light chain CDR3 sequence having the consensus sequence $X_1X_2X_3X_4X_5X_6PX_7T$ (SEQ ID NO:624), wherein $X_1$ is Q, A, V, or P; $X_2$ is Q, K, H, or L; $X_3$ is Y, M, G, or S; $X_4$ is N, D, R, Y, S, L, or T; $X_5$ is S, T, A, E, or H; $X_6$ is Y, R, F, or D; and $X_7$ is L, M, or Y. In some embodiments, the light chain CDR3 consensus sequence comprises the sequence of any one of SEQ ID NOS:460-462.

Preparation of Antibodies

For preparing an anti-Tau antibody, many techniques known in the art can be used. In some embodiments, antibodies are prepared by immunizing an animal or animals (e.g., mice, rabbits, or rats) with an antigen or a mixture of antigens for the induction of an antibody response. In some embodiments, the antigen or mixture of antigens is administered in conjugation with an adjuvant (e.g., Freund's adjuvant). After an initial immunization, one or more subsequent booster injections of the antigen or antigens may be administered to improve antibody production. Following immunization, antigen-specific B cells are harvested, e.g., from the spleen and/or lymphoid tissue. Methods of preparing antibodies are described in the Examples section below. In some embodiments, a method of preparing an anti-Tau antibody comprises immunizing an animal with a mixture of antigens, wherein the mixture of antigens comprises an unphosphorylated Tau (e.g., recombinant human Tau) and a phosphorylated Tau (e.g., a phosphorylated human Tau).

The genes encoding the heavy and light chains of an antibody of interest can be cloned from a cell, e.g., the genes encoding a monoclonal antibody can be cloned from a hybridoma and used to produce a recombinant monoclonal antibody. Gene libraries encoding heavy and light chains of monoclonal antibodies can also be made from hybridoma or plasma cells. Alternatively, phage or yeast display technology can be used to identify antibodies and Fab fragments that specifically bind to selected antigens. Techniques for the production of single chain antibodies or recombinant antibodies can also be adapted to produce antibodies. Antibodies can also be made bispecific, i.e., able to recognize two different antigens. Antibodies can also be heteroconjugates, e.g., two covalently joined antibodies, or immunotoxins.

Antibodies can be produced using any number of expression systems, including prokaryotic and eukaryotic expression systems. In some embodiments, the expression system is a mammalian cell expression, such as a hybridoma, or a CHO cell expression system. Many such systems are widely available from commercial suppliers. In embodiments in which an antibody comprises both a VH and VL region, the VH and VL regions may be expressed using a single vector, e.g., in a di-cistronic expression unit, or under the control of different promoters. In other embodiments, the VH and VL region may be expressed using separate vectors. A VH or VL region as described herein may optionally comprise a methionine at the N-terminus. Methods of generating and screening hybridoma cell lines, including the selection and immunization of suitable animals, the isolation and fusion of appropriate cells to create the hybridomas, the screening of hybridomas for the secretion of desired antibodies, and characterization of the antibodies are known to one of ordinary skill in the art. Non-limiting examples are also described in Example 6 herein. In some embodiments, the hybridoma cell line produces (e.g., secretes) an anti-Tau antibody of the present invention (e.g., anti-Tau antibody 17G2.A1, 19F7.C9, or 24D2.B2).

In some embodiments, the antibody is a chimeric antibody. Methods for making chimeric antibodies are known in the art. For example, chimeric antibodies can be made in which the antigen-binding region (heavy chain variable region and light chain variable region) from one species, such as a mouse, is fused to the effector region (constant domain) of another species, such as a human. As another example, "class switched" chimeric antibodies can be made in which the effector region of an antibody is substituted with an effector region of a different immunoglobulin class or subclass.

In some embodiments, the antibody is a humanized antibody. Generally, a non-human antibody is humanized in order to reduce its immunogenicity. Humanized antibodies typically comprise one or more variable regions (e.g., CDRs) or portions thereof that are non-human (e.g., derived from a mouse variable region sequence), and possibly some framework regions or portions thereof that are non-human, and further comprise one or more constant regions that are derived from human antibody sequences. Methods for humanizing non-human antibodies are known in the art. Transgenic mice, or other organisms such as other mammals, can be used to express humanized or human antibodies. Other methods of humanizing antibodies include, for example, variable region resurfacing, CDR grafting, grafting specificity-determining residues (SDR), guided selection, and framework shuffling.

As an alternative to humanization, fully human antibodies can be generated. As a non-limiting example, transgenic animals (e.g., mice) can be produced that are capable, upon immunization, of producing a full repertoire of human antibodies in the absence of endogenous immunoglobulin production. For example, it has been described that the homozygous deletion of the antibody heavy-chain joining region (JH) gene in chimeric and germ-line mutant mice results in complete inhibition of endogenous antibody production. Transfer of the human germ-line immunoglobulin gene array in such germ-line mutant mice will result in the production of human antibodies upon antigen challenge. As another example, human antibodies can be produced by hybridoma-based methods, such as by using primary human B cells for generating cell lines producing human monoclonal antibodies.

Human antibodies can also be produced using phage display or yeast display technology. In phage display, repertoires of variable heavy chain and variable light chain genes are amplified and expressed in phage display vectors. In some embodiments, the antibody library is a natural repertoire amplified from a human source. In some embodiments, the antibody library is a synthetic library made by cloning heavy chain and light chain sequences and recombining to generate a large pool of antibodies with different antigenic specificity. Phage typically display antibody fragments (e.g., Fab fragments or scFv fragments), which are then screened for binding to an antigen of interest.

In some embodiments, antibody fragments (such as a Fab, a Fab', a F(ab')$_2$, a scFv, a $V_H$, a $V_{HH}$, or a diabody) are generated. Various techniques have been developed for the production of antibody fragments. Traditionally, these fragments were derived via proteolytic digestion of intact antibodies. However, these fragments can now be produced directly using recombinant host cells. For example, antibody fragments can be isolated from antibody phage libraries. Alternatively, Fab'-SH fragments can be directly recovered from E. coli cells and chemically coupled to form F(ab')$_2$ fragments. According to another approach, F(ab')$_2$ fragments can be isolated directly from recombinant host cell culture. Other techniques for the production of antibody fragments will be apparent to those skilled in the art.

In some embodiments, the antibody or an antibody fragment is conjugated to another molecule, e.g., polyethylene glycol (PEGylation) or serum albumin, to provide an extended half-life in vivo.

Multispecific Antibodies

In some embodiments, multispecific antibodies comprising an anti-Tau antibody (or antigen-binding portion thereof) as described herein are provided, e.g., a bispecific antibody. In some embodiments, a multispecific antibody (e.g., a bispecific antibody) has a variable region that has a binding specificity for Tau and another variable region that has a binding specificity for at least one other antigen. In some embodiments, a multispecific antibody (e.g., a bispecific antibody) binds to two different epitopes of Tau.

In some embodiments, an anti-Tau antibody comprises:

(a) a first antigen-binding portion comprising a first variable region that specifically binds to a Tau protein (e.g., a human Tau protein), wherein the first antigen-binding portion comprises (i) a first heavy chain comprising a first Fc polypeptide and (ii) a first light chain; and (b) a second antigen-binding portion comprising a second variable region that specifically binds to the Tau protein (e.g., the human Tau protein), wherein the second antigen-binding portion comprises (i) a second heavy chain comprising a second Fc polypeptide and (ii) a second light chain, wherein the first Fc polypeptide and the second Fc polypeptide form an Fc dimer. In some embodiments, the first Fc polypeptide is a modified Fc polypeptide and/or the second Fc polypeptide is a modified Fc polypeptide.

In some embodiments, an anti-Tau antibody comprises:

(a) a first antigen-binding portion comprising a first variable region that specifically binds to a Tau protein (e.g., a human Tau protein), wherein the first antigen-binding portion comprises (i) a first heavy chain comprising a first Fc polypeptide and (ii) a first light chain; and (b) a second antigen-binding portion comprising a second variable region that specifically binds to the Tau protein (e.g., the human Tau protein), wherein the second antigen-binding portion comprises (i) a second heavy chain comprising a second Fc polypeptide and (ii) a second light chain, wherein the first Fc polypeptide and the second Fc polypeptide form an Fc dimer and wherein the first Fc polypeptide is a modified Fc polypeptide and/or the second Fc polypeptide is a modified Fc polypeptide.

In some embodiments, the first and second variable regions recognize the same epitope in the Tau protein. In some embodiments, the first and second variable regions recognize different epitopes in the Tau protein.

Methods for making multispecific antibodies include, but are not limited to, recombinant co-expression of two pairs of heavy chain and light chain in a host cell, "knobs-into-holes" engineering, "diabody" technology, intramolecular trimerization, and fusion of an antibody fragment to the N-terminus or C-terminus of another antibody, e.g., tandem variable domains.

Nucleic Acids, Vectors, and Host Cells

In some embodiments, the anti-Tau antibodies as described herein are prepared using recombinant methods. Accordingly, in some aspects, the invention provides isolated nucleic acids comprising a nucleic acid sequence encoding any of the anti-Tau antibodies as described herein (e.g., any one or more of the CDRs, heavy chain variable regions, and light chain variable regions described herein); vectors comprising such nucleic acids; and host cells into which the nucleic acids are introduced that are used to replicate the antibody-encoding nucleic acids and/or to express the antibodies.

In some embodiments, a polynucleotide (e.g., an isolated polynucleotide) comprises a nucleotide sequence encoding an antibody or antigen-binding portion thereof as described herein (e.g., as described in the Section above entitled "Anti-Tau Antibody Sequences"). In some embodiments, the polynucleotide comprises a nucleotide sequence encoding one or more amino acid sequences (e.g., CDR, heavy chain, light chain, and/or framework regions) disclosed in the Sequence Listing. In some embodiments, the polynucleotide comprises a nucleotide sequence encoding an amino acid sequence having at least 85% sequence identity (e.g., at least 85%, at least 90%, at least 91%, at least 92%, at least 93%, at least 94%, at least 95%, at least 96%, at least 97%, at least 98%, or at least 99% sequence identity) to a sequence (e.g., a CDR, heavy chain, light chain, or framework region sequence) disclosed in the Sequence Listing. In some embodiments, a polynucleotide as described herein is operably linked to a heterologous nucleic acid, e.g., a heterologous promoter.

Suitable vectors containing polynucleotides encoding antibodies of the present disclosure, or fragments thereof, include cloning vectors and expression vectors. While the cloning vector selected may vary according to the host cell intended to be used, useful cloning vectors generally have the ability to self-replicate, may possess a single target for a particular restriction endonuclease, and/or may carry genes for a marker that can be used in selecting clones containing the vector. Examples include plasmids and bacterial viruses, e.g., pUC18, pUC19, Bluescript (e.g., pBS SK+) and its derivatives, mp18, mp19, pBR322, pMB9, ColE1, pCR1, RP4, phage DNAs, and shuttle vectors such as pSA3 and pAT28. These and many other cloning vectors are available from commercial vendors such as BioRad, Strategene, and Invitrogen.

Expression vectors generally are replicable polynucleotide constructs that contain a nucleic acid of the present disclosure. The expression vector may replicate in the host cells either as episomes or as an integral part of the chromosomal DNA. Suitable expression vectors include but are not limited to plasmids, viral vectors, including adenoviruses, adeno-associated viruses, retroviruses, and any other vector.

Suitable host cells for cloning or expressing a polynucleotide or vector as described herein include prokaryotic or eukaryotic cells. In some embodiments, the host cell is prokaryotic. In some embodiments, the host cell is eukaryotic, e.g., Chinese Hamster Ovary (CHO) cells or lymphoid cells. In some embodiments, the host cell is a human cell, e.g., a Human Embryonic Kidney (HEK) cell.

In a further aspect, methods of making an anti-Tau antibody as described herein are provided. In some embodiments, the method includes culturing a host cell as described herein (e.g., a host cell expressing a polynucleotide or vector as described herein) under conditions suitable for expression of the antibody. In some embodiments, the antibody is subsequently recovered from the host cell (or host cell culture medium).

IV. Fc Polypeptide Modifications for Blood-Brain Barrier (BBB) Receptor Binding

In some aspects, provided herein are anti-Tau antibodies that are capable of being transported across the blood-brain barrier (BBB). Such an antibody comprises a modified Fc polypeptide that binds to a BBB receptor. BBB receptors are expressed on BBB endothelia, as well as other cell and tissue types. In some embodiments, the BBB receptor is transferrin receptor (TfR).

Amino acid residues designated in various Fc modifications, including those introduced in a modified Fc polypeptide that binds to a BBB receptor, e.g., TfR, are numbered herein using EU index numbering. Any Fc polypeptide, e.g., an IgG1, IgG2, IgG3, or IgG4 Fc polypeptide, may have modifications, e.g., amino acid substitutions, in one or more positions as described herein.

In some embodiments, an anti-Tau antibody comprises a first and optionally a second Fc polypeptide, each of which can be independently modified. In some embodiments, modifications (e.g., that promote TfR binding) that are made to the first and/or second Fc polypeptides result in an increase in brain uptake of the antibody (or antigen-binding portion thereof) that is increased by at least about 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, or more, compared to the uptake without the modifications having been made.

A modified (e.g., enhancing heterodimerization and/or BBB receptor-binding) Fc polypeptide present in an anti-Tau antibody of the invention can have at least 70% identity, at least 75% identity, at least 80% identity, at least 85% identity, at least 90% identity, or at least 95% identity to a native Fc region sequence or a fragment thereof, e.g., a fragment of at least 50 amino acids or at least 100 amino acids, or greater in length. In some embodiments, the native Fc amino acid sequence is the Fc region sequence of SEQ ID NO:181. In some embodiments, the modified Fc polypeptide has at least 70% identity, at least 75% identity, at least 80% identity, at least 85% identity, at least 90% identity, or at least 95% identity to amino acids 1-110 of SEQ ID NO:181, or to amino acids 111-217 of SEQ ID NO:181, or a fragment thereof, e.g., a fragment of at least 50 amino acids or at least 100 amino acids, or greater in length.

In some embodiments, a modified (e.g., enhancing heterodimerization and/or BBB receptor-binding) Fc polypeptide comprises at least 50 amino acids, or at least 60, 65, 70, 75, 80, 85, 90, or 95 or more, or at least 100 amino acids, or more, that correspond to a native Fc region amino acid sequence. In some embodiments, the modified Fc polypeptide comprises at least 25 contiguous amino acids, or at least 30, 35, 40, or 45 contiguous amino acids, or 50 contiguous amino acids, or at least 60, 65, 70, 75, 80 85, 90, or 95 or more contiguous amino acids, or 100 or more contiguous amino acids, that correspond to a native Fc region amino acid sequence, such as SEQ ID NO:181.

In some embodiments, the domain that is modified for BBB receptor-binding activity is a human Ig CH3 domain, such as an IgG1 CH3 domain. The CH3 domain can be of any IgG subtype, i.e., from IgG1, IgG2, IgG3, or IgG4. In the context of IgG1 antibodies, a CH3 domain refers to the segment of amino acids from about position 341 to about position 447 as numbered according to the EU numbering scheme.

In some embodiments, the domain that is modified for BBB receptor-binding activity is a human Ig CH2 domain, such as an IgG CH2 domain. The CH2 domain can be of any IgG subtype, i.e., from IgG1, IgG2, IgG3, or IgG4. In the context of IgG1 antibodies, a CH2 domain refers to the segment of amino acids from about position 231 to about position 340 as numbered according to the EU numbering scheme.

In some embodiments, a modified (e.g., BBB receptor-binding) Fc polypeptide present in an anti-Tau antibody of the invention comprises at least one, two, or three substitutions; and in some embodiments, at least four five, six, seven, eight, nine, or ten substitutions at amino acid positions comprising 266, 267, 268, 269, 270, 271, 295, 297, 298, and 299, according to the EU numbering scheme.

In some embodiments, a modified (e.g., BBB receptor-binding) Fc polypeptide present in an anti-Tau antibody of the invention comprises at least one, two, or three substitutions; and in some embodiments, at least four, five, six, seven, eight, or nine substitutions at amino acid positions comprising 274, 276, 283, 285, 286, 287, 288, 289, and 290, according to the EU numbering scheme.

In some embodiments, a modified (e.g., BBB receptor-binding) Fc polypeptide present in an anti-Tau antibody of the invention comprises at least one, two, or three substitutions; and in some embodiments, at least four, five, six, seven, eight, nine, or ten substitutions at amino acid positions comprising 268, 269, 270, 271, 272, 292, 293, 294, 296, and 300, according to the EU numbering scheme.

In some embodiments, a modified (e.g., BBB receptor-binding) Fc polypeptide present in an anti-Tau antibody of the invention comprises at least one, two, or three substitutions; and in some embodiments, at least four, five, six, seven, eight, or nine substitutions at amino acid positions comprising 272, 274, 276, 322, 324, 326, 329, 330, and 331, according to the EU numbering scheme.

In some embodiments, a modified (e.g., BBB receptor-binding) Fc polypeptide present in an anti-Tau antibody of the invention comprises at least one, two, or three substitutions; and in some embodiments, at least four, five, six, or seven substitutions at amino acid positions comprising 345, 346, 347, 349, 437, 438, 439, and 440, according to the EU numbering scheme.

In some embodiments, a modified (e.g., BBB receptor-binding) Fc polypeptide present in an anti-Tau antibody of the invention comprises at least one, two, or three substitutions; and in some embodiments, at least four, five, six, seven, eight, or nine substitutions at amino acid positions 384, 386, 387, 388, 389, 390, 413, 416, and 421, according to the EU numbering scheme.

FcRn Binding Sites

In certain aspects, modified (e.g., BBB receptor-binding) Fc polypeptides, or Fc polypeptides present in an anti-Tau antibody of the invention that do not specifically bind to a BBB receptor, can also comprise an FcRn binding site. In some embodiments, the FcRn binding site is within the Fc polypeptide or a fragment thereof.

In some embodiments, the FcRn binding site comprises a native FcRn binding site. In some embodiments, the FcRn binding site does not comprise amino acid changes relative to the amino acid sequence of a native FcRn binding site. In some embodiments, the native FcRn binding site is an IgG binding site, e.g., a human IgG binding site. In some embodiments, the FcRn binding site comprises a modification that alters FcRn binding.

In some embodiments, an FcRn binding site has one or more amino acid residues that are mutated, e.g., substituted, wherein the mutation(s) increase serum half-life or do not substantially reduce serum half-life (i.e., reduce serum half-life by no more than 25% compared to a counterpart modified Fc polypeptide having the wild-type residues at the mutated positions when assayed under the same conditions). In some embodiments, an FcRn binding site has one or more amino acid residues that are substituted at positions 251-256, 428, and 433-436, according to the EU numbering scheme.

In some embodiments, one or more residues at or near an FcRn binding site are mutated, relative to a native human IgG sequence, to extend serum half-life of the modified polypeptide. In some embodiments, a mutation, e.g., a substitution, is introduced at one or more of positions 244-257, 279-284, 307-317, 383-390, and 428-435, according to the EU numbering scheme. In some embodiments, one or more mutations are introduced at positions 251, 252, 254, 255, 256, 307, 308, 309, 311, 312, 314, 385, 386, 387, 389, 428, 433, 434, or 436, according to the EU numbering scheme. In some embodiments, mutations are introduced into one, two, or three of positions 252, 254, and 256. In some embodiments, the mutations are M252Y, S254T, and T256E. In some embodiments, a modified Fc polypeptide further comprises the mutations M252Y, S254T, and T256E. In some embodiments, the mutations are M428L and/or N434S. In some embodiments, a modified Fc polypeptide further comprises the mutation N434S with or without M428L. In some embodiments, a modified Fc polypeptide comprises a mutation at one, two, or all three of positions T307, E380, and N434, according to the EU numbering scheme. In some embodiments, the mutations are T307Q and N434A. In some embodiments, a modified Fc polypeptide comprises mutations T307A, E380A, and N434A. In some embodiments, a modified Fc polypeptide comprises mutations at positions T250 and M428, according to the EU numbering scheme. In some embodiments, the modified Fc polypeptide comprises mutations T250Q and/or M428L. In some embodiments, a modified Fc polypeptide comprises mutations at positions M428 and N434, according to the EU numbering scheme. In some embodiments, the modified Fc polypeptide comprises mutations M428L and N434S. In some embodiments, the modified Fc polypeptide comprises an N434S or N434A mutation.

V. Transferrin Receptor-Binding Fc Polypeptides

This section describes generation of modified Fc polypeptides in accordance with the invention that bind to transferrin receptor (TfR) and are capable of being transported across the blood-brain barrier (BBB).

TfR-Binding Fc Polypeptides Comprising Mutations in the CH3 Domain

In some embodiments, a modified Fc polypeptide that specifically binds to TfR comprises substitutions in a CH3 domain. In some embodiments, a modified Fc polypeptide comprises a human Ig CH3 domain, such as an IgG CH3 domain, that is modified for TfR-binding activity. The CH3 domain can be of any IgG subtype, i.e., from IgG1, IgG2, IgG3, or IgG4. In the context of IgG antibodies, a CH3 domain refers to the segment of amino acids from about position 341 to about position 447 as numbered according to the EU numbering scheme.

In some embodiments, a modified Fc polypeptide that specifically binds to TfR binds to the apical domain of TfR and may bind to TfR without blocking or otherwise inhibiting binding of transferrin to TfR. In some embodiments, binding of transferrin to TfR is not substantially inhibited. In some embodiments, binding of transferrin to TfR is inhibited by less than about 50% (e.g., less than about 45%, 40%, 35%, 30%, 25%, 20%, 15%, 10%, or 5%). In some embodiments, binding of transferrin to TfR is inhibited by less than about 20% (e.g., less than about 19%, 18%, 17%, 16%, 15%, 14%, 13%, 12%, 11%, 10%, 9%, 8%, 7%, 6%, 5%, 4%, 3%, 2%, or 1%).

In some embodiments, a modified Fc polypeptide that specifically binds to TfR comprises at least two, three, four, five, six, seven, eight, or nine substitutions at positions 384, 386, 387, 388, 389, 390, 413, 416, and 421, according to the EU numbering scheme. Illustrative substitutions that may be introduced at these positions are shown in Tables 13 and 14. In some embodiments, the amino acid at position 388 and/or 421 is an aromatic amino acid, e.g., Trp, Phe, or Tyr. In some embodiments, the amino acid at position 388 is Trp. In some embodiments, the aromatic amino acid at position 421 is Trp or Phe.

In some embodiments, at least one position as follows is substituted: Leu, Tyr, Met, or Val at position 384; Leu, Thr, His, or Pro at position 386; Val, Pro, or an acidic amino acid at position 387; an aromatic amino acid, e.g., Trp at position 388; Val, Ser, or Ala at position 389; an acidic amino acid, Ala, Ser, Leu, Thr, or Pro at position 413; Thr or an acidic amino acid at position 416; or Trp, Tyr, His, or Phe at position 421. In some embodiments, the modified Fc polypeptide may comprise a conservative substitution, e.g., an amino acid in the same charge grouping, hydrophobicity grouping, side chain ring structure grouping (e.g., aromatic amino acids), or size grouping, and/or polar or non-polar grouping, of a specified amino acid at one or more of the positions in the set. Thus, for example, Ile may be present at position 384, 386, and/or position 413. In some embodiments, the acidic amino acid at position one, two, or each of positions 387, 413, and 416 is Glu. In other embodiments, the acidic amino acid at one, two or each of positions 387, 413, and 416 is Asp. In some embodiments, two, three, four, five, six, seven, or all eight of positions 384, 386, 387, 388, 389, 413, 416, and 421 have an amino acid substitution as specified in this paragraph.

In some embodiments, an Fc polypeptide that is modified as described in the preceding two paragraphs comprises a native Asn at position 390. In some embodiments, the modified Fc polypeptide comprises Gly, His, Gln, Leu, Lys, Val, Phe, Ser, Ala, or Asp at position 390. In some embodiments, the modified Fc polypeptide further comprises one, two, three, or four substitutions at positions comprising 380, 391, 392, and 415, according to the EU numbering scheme. In some embodiments, Trp, Tyr, Leu, or Gln may be present at position 380. In some embodiments, Ser, Thr, Gln, or Phe may be present at position 391. In some embodiments, Gln, Phe, or His may be present at position 392. In some embodiments, Glu may be present at position 415.

In certain embodiments, the modified Fc polypeptide comprises two, three, four, five, six, seven, eight, nine, ten, or eleven positions selected from the following: Trp, Leu, or Glu at position 380; Tyr or Phe at position 384; Thr at position 386; Glu at position 387; Trp at position 388; Ser, Ala, Val, or Asn at position 389; Ser or Asn at position 390; Thr or Ser at position 413; Glu or Ser at position 415; Glu at position 416; and/or Phe at position 421. In some embodiments, the modified Fc polypeptide comprises all eleven positions as follows: Trp, Leu, or Glu at position 380; Tyr or Phe at position 384; Thr at position 386; Glu at position 387; Trp at position 388; Ser, Ala, Val, or Asn at position 389; Ser or Asn at position 390; Thr or Ser at position 413; Glu or Ser at position 415; Glu at position 416; and/or Phe at position 421.

In certain embodiments, the modified Fc polypeptide comprises Leu or Met at position 384; Leu, His, or Pro at position 386; Val at position 387; Trp at position 388; Val or Ala at position 389; Pro at position 413; Thr at position 416; and/or Trp at position 421. In some embodiments, the modified Fc polypeptide further comprises Ser, Thr, Gln, or Phe at position 391. In some embodiments, the modified Fc polypeptide further comprises Trp, Tyr, Leu, or Gln at position 380 and/or Gln, Phe, or His at position 392. In some embodiments, Trp is present at position 380 and/or Gln is present at position 392. In some embodiments, the modified Fc polypeptide does not have a Trp at position 380.

In other embodiments, the modified Fc polypeptide comprises Tyr at position 384; Thr at position 386; Glu or Val and position 387; Trp at position 388; Ser at position 389; Ser or Thr at position 413; Glu at position 416; and/or Phe at position 421. In some embodiments, the modified Fc polypeptide comprises a native Asn at position 390. In certain embodiments, the modified Fc polypeptide further comprises Trp, Tyr, Leu, or Gln at position 380; and/or Glu at position 415. In some embodiments, the modified Fc polypeptide further comprises Trp at position 380 and/or Glu at position 415.

In additional embodiments, the modified Fc polypeptide further comprises one, two, or three substitutions at positions comprising 414, 424, and 426, according to the EU numbering scheme. In some embodiments, position 414 is Lys, Arg, Gly, or Pro; position 424 is Ser, Thr, Glu, or Lys; and/or position 426 is Ser, Trp, or Gly.

In some embodiments, the modified Fc polypeptide comprises one or more of the following substitutions: Trp at position 380; Thr at position 386; Trp at position 388; Val at position 389; Thr or Ser at position 413; Glu at position 415; and/or Phe at position 421, according to the EU numbering scheme.

In some embodiments, the modified Fc polypeptide has at least 70% identity, at least 75% identity, at least 80% identity, at least 85% identity, at least 90% identity, or at least 95% identity to amino acids 111-217 of any one of SEQ ID NOS:184-278 (e.g., SEQ ID NOS:214-218, 238, 240-270, and 469-475). In some embodiments, the modified Fc polypeptide has at least 70% identity, at least 75% identity, at least 80% identity, at least 85% identity, at least 90% identity, or at least 95% identity to any one of SEQ ID NOS:184-278 (e.g., SEQ ID NOS:214-218, 238, 240-270, and 469-475). In some embodiments, the modified Fc polypeptide comprises the amino acids at EU index positions 384-390 and/or 413-421 of any one of SEQ ID NOS:184-278 (e.g., SEQ ID NOS:214-218, 238, 240-270, and 469-475). In some embodiments, the modified Fc polypeptide comprises the amino acids at EU index positions 380-390 and/or 413-421 of any one of SEQ ID NOS:184-278 (e.g., SEQ ID NOS:214-218, 238, 240-270, and 469-475). In some embodiments, the modified Fc polypeptide comprises the amino acids at EU index positions 380-392 and/or 413-426 of any one of SEQ ID NOS:184-278 (e.g., SEQ ID NOS:214-218, 238, 240-270, and 469-475).

In some embodiments, the modified Fc polypeptide has at least 75% identity, at least 80% identity, at least 85% identity, at least 90% identity, or at least 95% identity to any one of SEQ ID NOS:184-278 (e.g., SEQ ID NOS:214-218, 238, 240-270, and 469-475), and further comprises at at least five, six, seven, eight, nine, ten, eleven, twelve, thirteen, fourteen, fifteen, or sixteen of the positions, numbered according to the EU index, as follows: Trp, Tyr, Leu, Gln, or Glu at position 380; Leu, Tyr, Met, or Val at position 384; Leu, Thr, His, or Pro at position 386; Val, Pro, or an acidic amino acid at position 387; an aromatic amino acid, e.g., Trp, at position 388; Val, Ser, or Ala at position 389; Ser or Asn at position 390; Ser, Thr, Gln, or Phe at position 391; Gln, Phe, or His at position 392; an acidic amino acid, Ala, Ser, Leu, Thr, or Pro at position 413; Lys, Arg, Gly or Pro at position 414; Glu or Ser at position 415; Thr or an acidic amino acid at position 416; Trp, Tyr, His or Phe at position 421; Ser, Thr, Glu or Lys at position 424; and Ser, Trp, or Gly at position 426.

In some embodiments, the modified Fc polypeptide comprises the amino acid sequence of any one of SEQ ID NOS:214-218, 238, 240-270, and 469-475. In other embodiments, the modified Fc polypeptide comprises the amino acid sequence of any one of SEQ ID NOS:214-218, 238, 240-270, and 469-475, but in which one, two, or three amino acids are substituted.

In some embodiments, the modified Fc polypeptide comprises additional mutations such as the mutations described in Section VI below, including, but not limited to, a knob mutation (e.g., T366W as numbered with reference to EU numbering), hole mutations (e.g., T366S, L368A, and Y407V as numbered with reference to EU numbering), mutations that modulate effector function (e.g., L234A, L235A, and/or P329G (e.g., L234A and L235A) as numbered with reference to EU numbering), and/or mutations that increase serum stability (e.g., (i) M252Y, S254T, and T256E as numbered with reference to EU numbering, or (ii) N434S with or without M428L as numbered with reference to EU numbering). By way of illustration, SEQ ID NOS: 271-278, 342-413, and 476-585 provide non-limiting examples of modified Fc polypeptides with mutations in the CH3 domain (e.g., CH3C.35.20.1, CH3C.35.23.2, CH3C.35.23.3, CH3C.35.23.4, CH3C.35.21.17.2, CH3C.35.23, CH3C.35.21, CH3C.35.20.1.1, CH3C.23.2.1, and CH3C.35.23.1.1) comprising one or more of these additional mutations.

In some embodiments, the modified Fc polypeptide comprises a knob mutation (e.g., T366W as numbered with reference to EU numbering) and has at least 85% identity, at least 90% identity, or at least 95% identity to the sequence of any one of SEQ ID NOS:271, 342, 354, 366, 378, 390, 402, 480, 492, and 504. In some embodiments, the modified Fc polypeptide comprises the sequence of any one of SEQ ID NOS:271, 342, 354, 366, 378, 390, 402, 480, 492, and 504.

In some embodiments, the modified Fc polypeptide comprises a knob mutation (e.g., T366W as numbered with reference to EU numbering) and mutations that modulate effector function (e.g., L234A, L235A, and/or P329G (e.g., L234A and L235A) as numbered with reference to EU numbering), and has at least 85% identity, at least 90% identity, or at least 95% identity to the sequence of any one of SEQ ID NOS:272, 343, 344, 355, 356, 367, 368, 379, 380, 391, 392, 403, 404, 476, 481, 482, 493, 494, 505, and 506. In some embodiments, the modified Fc polypeptide comprises the sequence of any one of SEQ ID NOS:272, 343, 344, 355, 356, 367, 368, 379, 380, 391, 392, 403, 404, 476, 481, 482, 493, 494, 505, and 506.

In some embodiments, the modified Fc polypeptide comprises a knob mutation (e.g., T366W as numbered with reference to EU numbering) and mutations that increase serum stability (e.g., M252Y, S254T, and T256E as numbered with reference to EU numbering), and has at least 85% identity, at least 90% identity, or at least 95% identity to the sequence of any one of SEQ ID NOS:273, 345, 357, 369, 381, 393, 405, 483, 495, and 507. In some embodiments, the modified Fc polypeptide comprises the sequence of any one of SEQ ID NOS:273, 345, 357, 369, 381, 393, 405, 483, 495, and 507.

In some embodiments, the modified Fc polypeptide comprises a knob mutation (e.g., T366W as numbered with reference to EU numbering) and mutations that increase serum stability (e.g., N434S with or without M428L as numbered with reference to EU numbering), and has at least 85% identity, at least 90% identity, or at least 95% identity to the sequence of any one of SEQ ID NOS:517, 524, 531, 538, 545, 552, 559, 566, 573, and 580. In some embodiments, the modified Fc polypeptide comprises the sequence of any one of SEQ ID NOS:517, 524, 531, 538, 545, 552, 559, 566, 573, and 580.

In some embodiments, the modified Fc polypeptide comprises a knob mutation (e.g., T366W as numbered with reference to EU numbering), mutations that modulate effector function (e.g., L234A, L235A, and/or P329G (e.g., L234A and L235A) as numbered with reference to EU numbering), and mutations that increase serum stability (e.g., M252Y, S254T, and T256E as numbered with reference to EU numbering), and has at least 85% identity, at least 90% identity, or at least 95% identity to the sequence of any one of SEQ ID NOS:274, 346, 347, 358, 359, 370, 371, 382, 383, 394, 395, 406, and 407, 477, 484, 485, 496, 497, 508, and 509. In some embodiments, the modified Fc polypeptide comprises the sequence of any one of SEQ ID NOS:274, 346, 347, 358, 359, 370, 371, 382, 383, 394, 395, 406, and 407, 477, 484, 485, 496, 497, 508, and 509.

In some embodiments, the modified Fc polypeptide comprises a knob mutation (e.g., T366W as numbered with reference to EU numbering), mutations that modulate effector function (e.g., L234A, L235A, and/or P329G (e.g., L234A and L235A) as numbered with reference to EU numbering), and mutations that increase serum stability (e.g., N434S with or without M428L as numbered with reference to EU numbering), and has at least 85% identity, at least 90% identity, or at least 95% identity to the sequence of any one of SEQ ID NOS:518, 519, 525, 526, 532, 533, 539, 540, 546, 547, 553, 554, 560, 561, 567, 568, 574, 575, 581, and 582. In some embodiments, the modified Fc polypeptide comprises the sequence of any one of SEQ ID NOS:518, 519, 525, 526, 532, 533, 539, 540, 546, 547, 553, 554, 560, 561, 567, 568, 574, 575, 581, and 582.

In some embodiments, the modified Fc polypeptide comprises hole mutations (e.g., T366S, L368A, and Y407V as numbered with reference to EU numbering) and has at least 85% identity, at least 90% identity, or at least 95% identity to the sequence of any one of SEQ ID NOS:275, 348, 360, 372, 384, 396, 408, 486, 498, and 510. In some embodiments, the modified Fc polypeptide comprises the sequence of any one of SEQ ID NOS:275, 348, 360, 372, 384, 396, 408, 486, 498, and 510.

In some embodiments, the modified Fc polypeptide comprises hole mutations (e.g., T366S, L368A, and Y407V as numbered with reference to EU numbering) and mutations that modulate effector function (e.g., L234A, L235A, and/or P329G (e.g., L234A and L235A) as numbered with reference to EU numbering), and has at least 85% identity, at least 90% identity, or at least 95% identity to the sequence of any one of SEQ ID NOS:276, 349, 350, 361, 362, 373, 374, 385, 386, 397, 398, 409, 410, 478, 487, 488, 499, 500, 511, and 512. In some embodiments, the modified Fc polypeptide comprises the sequence of any one of SEQ ID NOS:276, 349, 350, 361, 362, 373, 374, 385, 386, 397, 398, 409, 410, 478, 487, 488, 499, 500, 511, and 512.

In some embodiments, the modified Fc polypeptide comprises hole mutations (e.g., T366S, L368A, and Y407V as numbered with reference to EU numbering) and mutations that increase serum stability (e.g., M252Y, S254T, and T256E as numbered with reference to EU numbering), and has at least 85% identity, at least 90% identity, or at least 95% identity to the sequence of any one of SEQ ID NOS:277, 351, 363, 375, 387, 399, 411, 489, 501, and 513. In some embodiments, the modified Fc polypeptide comprises the sequence of any one of SEQ ID NOS:277, 351, 363, 375, 387, 399, 411, 489, 501, and 513.

In some embodiments, the modified Fc polypeptide comprises hole mutations (e.g., T366S, L368A, and Y407V as numbered with reference to EU numbering) and mutations that increase serum stability (e.g., N434S with or without M428L as numbered with reference to EU numbering), and has at least 85% identity, at least 90% identity, or at least 95% identity to the sequence of any one of SEQ ID NOS:520, 527, 534, 541, 548, 555, 562, 569, 576, and 583. In some embodiments, the modified Fc polypeptide comprises the sequence of any one of SEQ ID NOS:520, 527, 534, 541, 548, 555, 562, 569, 576, and 583.

In some embodiments, the modified Fc polypeptide comprises hole mutations (e.g., T366S, L368A, and Y407V as numbered with reference to EU numbering), mutations that modulate effector function (e.g., L234A, L235A, and/or P329G (e.g., L234A and L235A) as numbered with reference to EU numbering), and mutations that increase serum stability (e.g., M252Y, S254T, and T256E as numbered with reference to EU numbering), and has at least 85% identity, at least 90% identity, or at least 95% identity to the sequence of any one of SEQ ID NOS:278, 352, 353, 364, 365, 376, 377, 388, 389, 400, 401, 412, 413, 479, 490, 491, 502, 503, 514, and 515. In some embodiments, the modified Fc polypeptide comprises the sequence of any one of SEQ ID NOS:278, 352, 353, 364, 365, 376, 377, 388, 389, 400, 401, 412, 413, 479, 490, 491, 502, 503, 514, and 515.

In some embodiments, the modified Fc polypeptide comprises hole mutations (e.g., T366S, L368A, and Y407V as numbered with reference to EU numbering), mutations that modulate effector function (e.g., L234A, L235A, and/or P329G (e.g., L234A and L235A) as numbered with reference to EU numbering), and mutations that increase serum stability (e.g., N434S with or without M428L as numbered with reference to EU numbering), and has at least 85% identity, at least 90% identity, or at least 95% identity to the sequence of any one of SEQ ID NOS:521, 522, 528, 529, 535, 536, 542, 543, 549, 550, 556, 557, 563, 564, 570, 571, 577, 578, 584, and 585. In some embodiments, the modified Fc polypeptide comprises the sequence of any one of SEQ ID NOS:521, 522, 528, 529, 535, 536, 542, 543, 549, 550, 556, 557, 563, 564, 570, 571, 577, 578, 584, and 585.

In some embodiments, a modified Fc polypeptide that specifically binds to TfR comprises at least two, three, four, five, six, seven, or eight substitutions at positions 345, 346, 347, 349, 437, 438, 439, and 440, according to the EU numbering scheme. Illustrative modified Fc polypeptides are provided in SEQ ID NOS:289-293. In some embodiments, the modified Fc polypeptide comprises Gly at position 437; Phe at position 438; and/or Asp at position 440. In some embodiments, Glu is present at position 440. In certain embodiments, the modified Fc polypeptide comprises at least one substitution at a position as follows: Phe or Ile at position 345; Asp, Glu, Gly, Ala, or Lys at position 346; Tyr, Met, Leu, Ile, or Asp at position 347; Thr or Ala at position 349; Gly at position 437; Phe at position 438; His Tyr, Ser, or Phe at position 439; or Asp at position 440. In some embodiments, two, three, four, five, six, seven, or all eight of positions 345, 346, 347, 349, 437, 438, 439, and 440 and have a substitution as specified in this paragraph. In some embodiments, the modified Fc polypeptide may comprise a conservative substitution, e.g., an amino acid in the same charge grouping, hydrophobicity grouping, side chain ring structure grouping (e.g., aromatic amino acids), or size grouping, and/or polar or non-polar grouping, of a specified amino acid at one or more of the positions in the set.

In some embodiments, the modified Fc polypeptide has at least 70% identity, at least 75% identity, at least 80% identity, at least 85% identity, at least 90% identity, or at least 95% identity to amino acids 111-217 of any one of SEQ ID NOS:289-293. In some embodiments, the modified Fc polypeptide has at least 70% identity, at least 75% identity, at least 80% identity, at least 85% identity, at least 90% identity, or at least 95% identity to SEQ ID NOS:289-293. In some embodiments, the modified Fc polypeptide comprises the amino acid sequence of any one of SEQ ID NOS:289-293. In other embodiments, the modified Fc polypeptide comprises the amino acid sequence of any one of SEQ ID NOS:289-293, but in which one, two, or three amino acids are substituted.

TfR-Binding Fc Polypeptides Comprising Mutations in the CH2 Domain

In some embodiments, a modified Fc polypeptide that specifically binds to TfR comprises substitutions in a CH2 domain. In some embodiments, a modified Fc polypeptide comprises a human Ig CH2 domain, such as an IgG CH2 domain, that is modified for TfR-binding activity. The CH2 domain can be of any IgG subtype, i.e., from IgG1, IgG2, IgG3, or IgG4. In the context of IgG antibodies, a CH2 domain refers to the segment of amino acids from about position 231 to about position 340 as numbered according to the EU numbering scheme.

In some embodiments, a modified Fc polypeptide that specifically binds to TfR comprises at least two, three, four, five, six, seven, eight, or nine substitutions at positions 274, 276, 283, 285, 286, 287, 288, and 290, according to the EU numbering scheme. Illustrative modified Fc polypeptides are provided in SEQ ID NOS:294-298. In some embodiments, the modified Fc polypeptide comprises Glu at position 287 and/or Trp at position 288. In some embodiments, the modified Fc polypeptide comprises at least one substitution at a position as follows: Glu, Gly, Gln, Ser, Ala, Asn, Tyr, or Trp at position 274; Ile, Val, Asp, Glu, Thr, Ala, or Tyr at position 276; Asp, Pro, Met, Leu, Ala, Asn, or Phe at position 283; Arg, Ser, Ala, or Gly at position 285; Tyr, Trp, Arg, or Val at position 286; Glu at position 287; Trp or Tyr at position 288; Gln, Tyr, His, Ile, Phe, Val, or Asp at position 289; or Leu, Trp, Arg, Asn, Tyr, or Val at position 290. In some embodiments, two, three, four, five, six, seven, eight, or all nine of positions 274, 276, 283, 285, 286, 287, 288, and 290 have a substitution as specified in this paragraph. In some embodiments, the modified Fc polypeptide may comprise a conservative substitution, e.g., an amino acid in the same charge grouping, hydrophobicity grouping, side chain ring structure grouping (e.g., aromatic amino acids), or size grouping, and/or polar or non-polar grouping, of a specified amino acid at one or more of the positions in the set.

In some embodiments, the modified Fc polypeptide comprises Glu, Gly, Gln, Ser, Ala, Asn, or Tyr at position 274; Ile, Val, Asp, Glu, Thr, Ala, or Tyr at position 276 Asp, Pro, Met, Leu, Ala, or Asn at position 283; Arg, Ser, or Ala at position 285; Tyr, Trp, Arg, or Val at position 286; Glu at position 287; Trp at position 288; Gln, Tyr, His, Ile, Phe, or Val at position 289; and/or Leu, Trp, Arg, Asn, or Tyr at position 290. In some embodiments, the modified Fc polypeptide comprises Arg at position 285; Tyr or Trp at position 286; Glu at position 287; Trp at position 288; and/or Arg or Trp at position 290.

In some embodiments, the modified Fc polypeptide has at least 70% identity, at least 75% identity, at least 80% identity, at least 85% identity, at least 90% identity, or at least 95% identity to amino acids 1-110 of any one of SEQ ID NOS:294-298. In some embodiments, the modified Fc polypeptide has at least 70% identity, at least 75% identity, at least 80% identity, at least 85% identity, at least 90% identity, or at least 95% identity to SEQ ID NOS:294-298. In some embodiments, the modified Fc polypeptide comprises the amino acid sequence of any one of SEQ ID NOS:294-298. In other embodiments, the modified Fc polypeptide comprises the amino acid sequence of any one of SEQ ID NOS:294-298, but in which one, two, or three amino acids are substituted.

In some embodiments, a modified Fc polypeptide that specifically binds to TfR comprises at least two, three, four, five, six, seven, eight, nine, or ten substitutions at positions 266, 267, 268, 269, 270, 271, 295, 297, 298, and 299, according to the EU numbering scheme. Illustrative modified Fc polypeptides are provided in SEQ ID NOS:299-303. In some embodiments, the modified Fc polypeptide comprises Pro at position 270, Glu at position 295, and/or Tyr at position 297. In some embodiments, the modified Fc polypeptide comprises at least one substitution at a position as follows: Pro, Phe, Ala, Met, or Asp at position 266; Gln, Pro, Arg, Lys, Ala, Ile, Leu, Glu, Asp, or Tyr at position 267; Thr, Ser, Gly, Met, Val, Phe, Trp, or Leu at position 268; Pro, Val, Ala, Thr, or Asp at position 269; Pro, Val, or Phe at position 270; Trp, Gln, Thr, or Glu at position 271; Glu, Val, Thr, Leu, or Trp at position 295; Tyr, His, Val, or Asp at position 297; Thr, His, Gln, Arg, Asn, or Val at position 298; or Tyr, Asn, Asp, Ser, or Pro at position 299. In some embodiments, two, three, four, five, six, seven, eight, nine, or all ten of positions 266, 267, 268, 269, 270, 271, 295, 297, 298, and 299 have a substitution as specified in this paragraph. In some embodiments, a modified Fc polypeptide may comprise a conservative substitution, e.g., an amino acid in the same charge grouping, hydrophobicity grouping, side chain ring structure grouping (e.g., aromatic amino acids), or size grouping, and/or polar or non-polar grouping, of a specified amino acid at one or more of the positions in the set.

In some embodiments, the modified Fc polypeptide comprises Pro, Phe, or Ala at position 266; Gln, Pro, Arg, Lys, Ala, or Ile at position 267; Thr, Ser, Gly, Met, Val, Phe, or Trp at position 268; Pro, Val, or Ala at position 269; Pro at position 270; Trp or Gln at position 271; Glu at position 295; Tyr at position 297; Thr, His, or Gln at position 298; and/or Tyr, Asn, Asp, or Ser at position 299.

In some embodiments, the modified Fc polypeptide comprises Met at position 266; Leu or Glu at position 267; Trp at position 268; Pro at position 269; Val at position 270; Thr at position 271; Val or Thr at position 295; His at position 197; His, Arg, or Asn at position 198; and/or Pro at position 299.

In some embodiments, the modified Fc polypeptide comprises Asp at position 266; Asp at position 267; Leu at position 268; Thr at position 269; Phe at position 270; Gln at position 271; Val or Leu at position 295; Val at position 297; Thr at position 298; and/or Pro at position 299.

In some embodiments, the modified Fc polypeptide has at least 70% identity, at least 75% identity, at least 80% identity, at least 85% identity, at least 90% identity, or at least 95% identity to amino acids 1-110 of any one of SEQ ID NOS:299-303. In some embodiments, the modified Fc polypeptide has at least 70% identity, at least 75% identity, at least 80% identity, at least 85% identity, at least 90% identity, or at least 95% identity to SEQ ID NOS:299-303. In some embodiments, the modified Fc polypeptide comprises the amino acid sequence of any one of SEQ ID NOS:299-303. In other embodiments, the modified Fc polypeptide comprises the amino acid sequence of any one of SEQ ID NOS:299-303, but in which one, two, or three amino acids are substituted.

In some embodiments, a modified Fc polypeptide that specifically binds to TfR comprises at least two, three, four, five, six, seven, eight, nine, or ten substitutions at positions 268, 269, 270, 271, 272, 292, 293, 294, and 300, according to the EU numbering scheme. Illustrative modified Fc polypeptides are provided in SEQ ID NOS:304-308. In some embodiments, the modified Fc polypeptide comprises at least one substitution at a position as follows: Val or Asp at position 268; Pro, Met, or Asp at position 269; Pro or Trp at position 270; Arg, Trp, Glu, or Thr at position 271; Met, Tyr, or Trp at position 272; Leu or Trp at position 292; Thr, Val, Ile, or Lys at position 293; Ser, Lys, Ala, or Leu at position 294; His, Leu, or Pro at position 296; or Val or Trp at position 300. In some embodiments, two, three, four, five, six, seven, eight, nine, or all ten of positions 268, 269, 270, 271, 272, 292, 293, 294, and 300 have a substitution as specified in this paragraph. In some embodiments, the modified Fc polypeptide may comprise a conservative substitution, e.g., an amino acid in the same charge grouping, hydrophobicity grouping, side chain ring structure grouping (e.g., aromatic amino acids), or size grouping, and/or polar or non-polar grouping, of a specified amino acid at one or more of the positions in the set.

In some embodiments, the modified Fc polypeptide comprises Val at position 268; Pro at position 269; Pro at position 270; Arg or Trp at position 271; Met at position 272; Leu at position 292; Thr at position 293; Ser at position 294; His at position 296; and/or Val at position 300.

In some embodiments, the modified Fc polypeptide comprises Asp at position 268; Met or Asp at position 269; Trp at position 270; Glu or Thr at position 271; Tyr or Trp at position 272; Trp at position 292; Val, Ile, or Lys at position 293; Lys, Ala, or Leu at position 294; Leu or Pro at position 296; and/or Trp at position 300.

In some embodiments, the modified Fc polypeptide has at least 70% identity, at least 75% identity, at least 80% identity, at least 85% identity, at least 90% identity, or at least 95% identity to amino acids 1-110 of any one of SEQ ID NOS:304-308. In some embodiments, the modified Fc polypeptide has at least 70% identity, at least 75% identity, at least 80% identity, at least 85% identity, at least 90% identity, or at least 95% identity to SEQ ID NOS:304-308. In some embodiments, the modified Fc polypeptide comprises the amino acid sequence of any one of SEQ ID NOS:304-308. In other embodiments, the modified Fc polypeptide comprises the amino acid sequence of any one of SEQ ID NOS:304-308, but in which one, two, or three amino acids are substituted.

In some embodiments, a modified Fc polypeptide that specifically binds to TfR has at least two, three, four, five, six, seven, eight, nine, or ten substitutions at positions 272, 274, 276, 322, 324, 326, 329, 330, and 331, according to the EU numbering scheme. Illustrative modified Fc polypeptides are provided in SEQ ID NOS:309-313. In some embodiments, the modified Fc polypeptide comprises Trp at position 330. In some embodiments, the modified Fc polypeptide comprises at least one substitution at a position as follows: Trp, Val, Ile, or Ala at position 272; Trp or Gly at position 274; Tyr, Arg, or Glu at position 276; Ser, Arg, or Gln at position 322; Val, Ser, or Phe at position 324; Ile, Ser, or Trp at position 326; Trp, Thr, Ser, Arg, or Asp at position 329; Trp at position 330; or Ser, Lys, Arg, or Val at position 331. In some embodiments, two, three, four, five, six, seven, eight, or all nine of positions 272, 274, 276, 322, 324, 326, 329, 330, and 331 have a substitution as specified in this paragraph. In some embodiments, the modified Fc polypeptide may comprise a conservative substitution, e.g., an amino acid in the same charge grouping, hydrophobicity grouping, side chain ring structure grouping (e.g., aromatic amino acids), or size grouping, and/or polar or non-polar grouping, of a specified amino acid at one or more of the positions in the set.

In some embodiments, the modified Fc polypeptide comprises two, three, four, five, six, seven, eight, or nine positions selected from the following: position 272 is Trp, Val, Ile, or Ala; position 274 is Trp or Gly; position 276 is Tyr, Arg, or Glu; position 322 is Ser, Arg, or Gln; position 324 is Val, Ser, or Phe; position 326 is Ile, Ser, or Trp; position 329 is Trp, Thr, Ser, Arg, or Asp; position 330 is Trp; and position 331 is Ser, Lys, Arg, or Val. In some embodiments, the modified Fc polypeptide comprises Val or Ile at position 272; Gly at position 274; Arg at position 276; Arg at position 322; Ser at position 324; Ser at position 326; Thr, Ser, or Arg at position 329; Trp at position 330; and/or Lys or Arg at position 331.

In some embodiments, the modified Fc polypeptide has at least 70% identity, at least 75% identity, at least 80% identity, at least 85% identity, at least 90% identity, or at least 95% identity to amino acids 1-110 of any one of SEQ ID NOS:309-313. In some embodiments, the modified Fc polypeptide has at least 70% identity, at least 75% identity, at least 80% identity, at least 85% identity, at least 90% identity, or at least 95% identity to SEQ ID NOS:309-313. In some embodiments, the modified Fc polypeptide comprises the amino acid sequence of any one of SEQ ID NOS:309-313. In other embodiments, the modified Fc polypeptide comprises the amino acid sequence of any one of SEQ ID NOS:309-313, but in which one, two, or three amino acids are substituted.

VI. Additional Fc Polypeptide Mutations

In some aspects, an anti-Tau antibody of the invention comprises two Fc polypeptides that may each comprise independently selected modifications or may be a wild-type Fc polypeptide, e.g., a human IgG1 Fc polypeptide. In some embodiments, one or both Fc polypeptides contains one or more modifications that confer binding to a blood-brain barrier (BBB) receptor, e.g., transferrin receptor (TfR). Non-limiting examples of other mutations that can be introduced into one or both Fc polypeptides include, e.g., mutations to increase serum stability, to modulate effector function, to influence glycosylation, to reduce immunogenicity in humans, and/or to provide for knob and hole heterodimerization of the Fc polypeptides.

In some embodiments, one or more Fc polypeptides (e.g., a first and optionally a second Fc polypeptide) has an amino acid sequence identity of at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% to a corresponding wild-type Fc polypeptide (e.g., a human IgG1, IgG2, IgG3, or IgG4 Fc polypeptide).

In some embodiments, the Fc polypeptides present in the anti-Tau antibody include knob and hole mutations to promote heterodimer formation and hinder homodimer formation. Generally, the modifications introduce a protuberance ("knob") at the interface of a first polypeptide and a corresponding cavity ("hole") in the interface of a second polypeptide, such that the protuberance can be positioned in the cavity so as to promote heterodimer formation and thus hinder homodimer formation. Protuberances are constructed by replacing small amino acid side chains from the interface of the first polypeptide with larger side chains (e.g., tyrosine or tryptophan). Compensatory cavities of identical or similar size to the protuberances are created in the interface of the second polypeptide by replacing large amino acid side chains with smaller ones (e.g., alanine or threonine). In some embodiments, such additional mutations are at a position in the Fc polypeptide that does not have a negative effect on binding of the polypeptide to a BBB receptor, e.g., TfR.

In one illustrative embodiment of a knob and hole approach for dimerization, position 366 (numbered according to the EU numbering scheme) of one of the Fc polypeptides present in the anti-Tau antibody comprises a tryptophan in place of a native threonine. The other Fc polypeptide in the dimer has a valine at position 407 (numbered according to the EU numbering scheme) in place of the native tyrosine. The other Fc polypeptide may further comprise a substitution in which the native threonine at position 366 (numbered according to the EU numbering scheme) is substituted with a serine and a native leucine at position 368 (numbered according to the EU numbering scheme) is substituted with an alanine. Thus, one of the Fc polypeptides of an anti-Tau antibody of the invention has the T366W knob mutation and the other Fc polypeptide has the Y407V mutation, which is typically accompanied by the T366S and L368A hole mutations.

In some embodiments, modifications to enhance serum half-life may be introduced. For example, in some embodiments, one or both Fc polypeptides present in an anti-Tau antibody of the invention may comprise a tyrosine at position 252, a threonine at position 254, and a glutamic acid at position 256, as numbered according to the EU numbering scheme. Thus, one or both Fc polypeptides may have M252Y, S254T, and T256E substitutions. Alternatively, one or both Fc polypeptides may have M428L and N434S substitutions, according to EU numbering. Alternatively, one or both Fc polypeptides may have N434S or N434A substitution.

Fc Effector Functions

In some embodiments, one or both Fc polypeptides may comprise modifications that reduce effector function, i.e., having a reduced ability to induce certain biological functions upon binding to an Fc receptor expressed on an effector cell that mediates the effector function. Examples of antibody effector functions include, but are not limited to, C1q binding and complement dependent cytotoxicity (CDC), Fc receptor binding, antibody-dependent cell-mediated cytotoxicity (ADCC), antibody-dependent cell-mediated phagocytosis (ADCP), down-regulation of cell surface receptors (e.g., B cell receptor), and B-cell activation. Effector functions may vary with the antibody class. For example, native human IgG1 and IgG3 antibodies can elicit ADCC and CDC activities upon binding to an appropriate Fc receptor present on an immune system cell; and native human IgG1, IgG2, IgG3, and IgG4 can elicit ADCP functions upon binding to the appropriate Fc receptor present on an immune cell.

In some embodiments, one or both Fc polypeptides may also be engineered to contain other modifications for heterodimerization, e.g., electrostatic engineering of contact residues within a CH3-CH3 interface that are naturally charged or hydrophobic patch modifications.

In some embodiments, one or both Fc polypeptides may include additional modifications that modulate effector function.

In some embodiments, one or both Fc polypeptides may comprise modifications that reduce or eliminate effector function. Illustrative Fc polypeptide mutations that reduce effector function include, but are not limited to, substitutions in a CH2 domain, e.g., at positions 234 and 235, according to the EU numbering scheme. For example, in some embodiments, one or both Fc polypeptides can comprise alanine residues at positions 234 and 235. Thus, one or both Fc polypeptides may have L234A and L235A (LALA) substitutions.

Additional Fc polypeptide mutations that modulate an effector function include, but are not limited to, one or more substitutions at positions 238, 265, 269, 270, 297, 327 and 329, according to the EU numbering scheme. Illustrative substitutions include the following: position 329 may have a mutation in which proline is substituted with a glycine or arginine or an amino acid residue large enough to destroy the Fc/Fcγ receptor interface that is formed between proline 329 of the Fc and tryptophan residues Trp 87 and Trp 110 of FcγRIII. Additional illustrative substitutions include S228P, E233P, L235E, N297A, N297D, and P331S, according to the EU numbering scheme. Multiple substitutions may also be present, e.g., L234A and L235A of a human IgG1 Fc region; L234A, L235A, and P329G of a human IgG1 Fc region; S228P and L235E of a human IgG4 Fc region; L234A and G237A of a human IgG1 Fc region; L234A, L235A, and G237A of a human IgG1 Fc region; V234A and G237A of a human IgG2 Fc region; L235A, G237A, and E318A of a human IgG4 Fc region; and S228P and L236E of a human IgG4 Fc region, according to the EU numbering scheme. In some embodiments, one or both Fc polypeptides may have one or more amino acid substitutions that modulate ADCC, e.g., substitutions at positions 298, 333, and/or 334, according to the EU numbering scheme.

Illustrative Fc Polypeptides Comprising Additional Mutations

By way of non-limiting example, one or both Fc polypeptides present in a fusion protein of the invention may comprise additional mutations including a knob mutation (e.g., T366W as numbered according to the EU numbering scheme), hole mutations (e.g., T366S, L368A, and Y407V as numbered according to the EU numbering scheme), mutations that modulate effector function (e.g., L234A, L235A, and/or P329G (e.g., L234A and L235A) as numbered according to the EU numbering scheme), and/or mutations that increase serum stability (e.g., (i) M252Y, S254T, and T256E as numbered according to the EU numbering scheme, or (ii) N434S with or without M428L as numbered with reference to EU numbering).

In some embodiments, an Fc polypeptide may have a knob mutation (e.g., T366W as numbered according to the EU numbering scheme) and at least 85% identity, at least 90% identity, or at least 95% identity to the sequence of any one of SEQ ID NOS:181, 184-270, 289-313, and 469-475. In some embodiments, an Fc polypeptide having the sequence of any one of SEQ ID NOS:181, 184-270, 289-313, and 469-475 may be modified to have a knob mutation.

In some embodiments, an Fc polypeptide may have a knob mutation (e.g., T366W as numbered according to the EU numbering scheme), mutations that modulate effector function (e.g., L234A, L235A, and/or P329G (e.g., L234A and L235A) as numbered according to the EU numbering scheme), and at least 85% identity, at least 90% identity, or at least 95% identity to the sequence of any one of SEQ ID NOS:181, 184-270, 289-313, and 469-475. In some embodiments, an Fc polypeptide having the sequence of any one of SEQ ID NOS:181, 184-270, 289-313, and 469-475 may be modified to have a knob mutation and mutations that modulate effector function.

In some embodiments, an Fc polypeptide may have a knob mutation (e.g., T366W as numbered according to the EU numbering scheme), mutations that increase serum stability (e.g., (i) M252Y, S254T, and T256E as numbered according to the EU numbering scheme, or (ii) N434S with or without M428L as numbered with reference to EU numbering), and at least 85% identity, at least 90% identity, or at least 95% identity to the sequence of any one of SEQ ID NOS:181, 184-270, 289-313, and 469-475. In some embodiments, an Fc polypeptide having the sequence of any one of SEQ ID NOS:181, 184-270, 289-313, and 469-475 may be modified to have a knob mutation and mutations that increase serum stability.

In some embodiments, an Fc polypeptide may have a knob mutation (e.g., T366W as numbered according to the EU numbering scheme), mutations that modulate effector function (e.g., L234A, L235A, and/or P329G (e.g., L234A and L235A) as numbered according to the EU numbering scheme), mutations that increase serum stability (e.g., (i) M252Y, S254T, and T256E as numbered according to the EU numbering scheme, or (ii) N434S with or without M428L as numbered with reference to EU numbering), and at least 85% identity, at least 90% identity, or at least 95% identity to the sequence of any one of SEQ ID NOS:181, 184-270, 289-313, and 469-475. In some embodiments, an Fc polypeptide having the sequence of any one of SEQ ID NOS:181, 184-270, 289-313, and 469-475 may be modified to have a knob mutation, mutations that modulate effector function, and mutations that increase serum stability.

In some embodiments, an Fc polypeptide may have hole mutations (e.g., T366S, L368A, and Y407V as numbered according to the EU numbering scheme) and at least 85% identity, at least 90% identity, or at least 95% identity to the sequence of any one of SEQ ID NOS:181, 184-270, 289-313, and 469-475. In some embodiments, an Fc polypeptide having the sequence of any one of SEQ ID NOS:181, 184-270, 289-313, and 469-475 may be modified to have hole mutations.

In some embodiments, an Fc polypeptide may have hole mutations (e.g., T366S, L368A, and Y407V as numbered according to the EU numbering scheme), mutations that modulate effector function (e.g., L234A, L235A, and/or P329G (e.g., L234A and L235A) as numbered according to the EU numbering scheme), and at least 85% identity, at least 90% identity, or at least 95% identity to the sequence of any one of SEQ ID NOS:181, 184-270, 289-313, and 469-475. In some embodiments, an Fc polypeptide having the sequence of any one of SEQ ID NOS:181, 184-270, 289-313, and 469-475 may be modified to have hole mutations and mutations that modulate effector function.

In some embodiments, an Fc polypeptide may have hole mutations (e.g., T366S, L368A, and Y407V as numbered according to the EU numbering scheme), mutations that increase serum stability (e.g., (i) M252Y, S254T, and T256E as numbered according to the EU numbering scheme, or (ii) N434S with or without M428L as numbered with reference to EU numbering), and at least 85% identity, at least 90% identity, or at least 95% identity to the sequence of any one of SEQ ID NOS:181, 184-270, 289-313, and 469-475. In some embodiments, an Fc polypeptide having the sequence of any one of SEQ ID NOS:181, 184-270, 289-313, and 469-475 may be modified to have hole mutations and mutations that increase serum stability.

In some embodiments, an Fc polypeptide may have hole mutations (e.g., T366S, L368A, and Y407V as numbered according to the EU numbering scheme), mutations that modulate effector function (e.g., L234A, L235A, and/or P329G (e.g., L234A and L235A) as numbered according to the EU numbering scheme), mutations that increase serum stability (e.g., (i) M252Y, S254T, and T256E as numbered according to the EU numbering scheme, or (ii) N434S with or without M428L as numbered with reference to EU numbering), and at least 85% identity, at least 90% identity, or at least 95% identity to the sequence of any one of SEQ ID NOS:181, 184-270, 289-313, and 469-475. In some embodiments, an Fc polypeptide having the sequence of any one of SEQ ID NOS:181, 184-270, 289-313, and 469-475 may be modified to have hole mutations, mutations that modulate effector function, and mutations that increase serum stability.

VII. Anti-Tau Antibodies Having Modified Fc Polypeptides

In some embodiments, an anti-Tau antibody described herein comprises a first Fc polypeptide having the knob (T366W according to EU numbering), LALA (L234A and L235A according to EU numbering), YTE (M252Y, S254T, and T256E according to EU numbering), and LS (N434S with or without M428L according to EU numbering) mutations as specified for each of SEQ ID NOS:271-274, 476, 477, and 559-561 and at least 85% identity, at least 90% identity, or at least 95% identity to the respective sequence, and a second Fc polypeptide having the sequence of SEQ ID NO:279. In some embodiments, an anti-Tau antibody described herein comprises a first Fc polypeptide having the sequence of any one of SEQ ID NOS:214-218, 238, 240-270, and 469-475 with a knob mutation (e.g., T366W substitution according to EU numbering), and a second Fc polypeptide having the sequence of SEQ ID NO:279. In some embodiments, an anti-Tau antibody described herein comprises a first Fc polypeptide having the sequence of SEQ ID NO:271 and a second Fc polypeptide having the sequence of SEQ ID NO:279. In some embodiments, an anti-Tau antibody described herein comprises a first Fc polypeptide having the sequence of SEQ ID NO:272 and a second Fc polypeptide having the sequence of SEQ ID NO:280. In some embodiments, an anti-Tau antibody described herein comprises a first Fc polypeptide having the sequence of SEQ ID NO:273 and a second Fc polypeptide having the sequence of SEQ ID NO:281. In some embodiments, an anti-Tau antibody described herein comprises a first Fc polypeptide having the sequence of SEQ ID NO:274 and a second Fc polypeptide having the sequence of SEQ ID NO:282.

In some embodiments, an anti-Tau antibody described herein comprises a first Fc polypeptide having the hole (T366S, L368A, and Y407V according to EU numbering), LALA (L234A and L235A according to EU numbering), YTE (M252Y, S254T, and T256E according to EU numbering), and LS (N434S with or without M428L according to EU numbering) mutations as specified for each of SEQ ID NOS:275-278, 478, 479, and 562-564 and has at least 85% identity, at least 90% identity, or at least 95% identity to the respective sequence, and a second Fc polypeptide having the sequence of SEQ ID NO:283. In some embodiments, an anti-Tau antibody described herein comprises a first Fc polypeptide having the sequence of any one of SEQ ID NOS:214-218, 238, 240-270, and 469-475 with a hole mutation (e.g., T366S, L368A, and/or Y407V substitutions according to EU numbering), and a second Fc polypeptide having the sequence of SEQ ID NO:283. In some embodiments, an anti-Tau antibody described herein comprises a first Fc polypeptide having the sequence of SEQ ID NO:275 and a second Fc polypeptide having the sequence of SEQ ID NO:283. In some embodiments, an anti-Tau antibody described herein comprises a first Fc polypeptide having the sequence of SEQ ID NO:276 and a second Fc polypeptide having the sequence of SEQ ID NO:284. In some embodiments, an anti-Tau antibody described herein comprises a first Fc polypeptide having the sequence of SEQ ID NO:277 and a second Fc polypeptide having the sequence of SEQ ID NO:285. In some embodiments, an anti-Tau antibody described herein comprises a first Fc polypeptide having the sequence of SEQ ID NO:278 and a second Fc polypeptide having the sequence of SEQ ID NO:286.

In some embodiments, an anti-Tau antibody described herein comprises a first Fc polypeptide having the knob (T366W according to EU numbering), LALA (L234A and L235A according to EU numbering), YTE (M252Y, S254T, and T256E according to EU numbering), and LS (N434S with or without M428L according to EU numbering) mutations as specified for each of SEQ ID NOS:271-274, 476, 477, and 559-561 and at least 85% identity, at least 90% identity, or at least 95% identity to the respective sequence, and a second Fc polypeptide having the hole (T366S, L368A, and Y407V according to EU numbering), LALA (L234A and L235A according to EU numbering), YTE (M252Y, S254T, and T256E according to EU numbering), and LS (N434S with or without M428L according to EU numbering) mutations as specified for each of SEQ ID NOS:275-278, 478, 479, and 562-564 and has at least 85% identity, at least 90% identity, or at least 95% identity to the respective sequence. In some embodiments, an anti-Tau antibody described herein comprises a first Fc polypeptide having the sequence of any one of SEQ ID NOS:214-218, 238, 240-270, and 469-475 with a knob mutation (e.g., T366W substitution according to EU numbering), and a second Fc polypeptide having the sequence of any one of SEQ ID NOS:214-218, 238, 240-270, and 469-475 with a hole mutation (e.g., T366S, L368A, and/or Y407V substitutions according to EU numbering). In some embodiments, an anti-Tau antibody described herein comprises a first Fc polypeptide having the sequence of SEQ ID NO:271 and a second Fc polypeptide having the sequence of SEQ ID NO:275. In some embodiments, an anti-Tau antibody described herein comprises a first Fc polypeptide having the sequence of SEQ ID NO:272 and a second Fc polypeptide having the sequence of SEQ ID NO:276. In some embodiments, an anti-Tau antibody described herein comprises a first Fc polypeptide having the sequence of SEQ ID NO:273 and a second Fc polypeptide having the sequence of SEQ ID NO:277. In some embodiments, an anti-Tau antibody described herein comprises a first Fc polypeptide having the sequence of SEQ ID NO:274 and a second Fc polypeptide having the sequence of SEQ ID NO:278.

In some embodiments, an anti-Tau antibody described herein comprises a first Fc polypeptide having the knob (T366W according to EU numbering), LALA (L234A and L235A according to EU numbering), YTE (M252Y, S254T, and T256E according to EU numbering), and LS (N434S with or without M428L according to EU numbering) mutations as specified for each of SEQ ID NOS:283-286 and 626-628 and has at least 85% identity, at least 90% identity, or at least 95% identity to the respective sequence, and a second Fc polypeptide having the hole (T366S, L368A, and Y407V according to EU numbering), LALA (L234A and L235A according to EU numbering), and YTE (M252Y, S254T, and T256E according to EU numbering) mutations as specified for each of SEQ ID NOS:279-282 and 629-631 and has at least 85% identity, at least 90% identity, or at least 95% identity to the respective sequence. In some embodiments, an anti-Tau antibody described herein comprises a first Fc polypeptide having the sequence of SEQ ID NO:283 and a second Fc polypeptide having the sequence of SEQ ID NO:279. In some embodiments, an anti-Tau antibody described herein comprises a first Fc polypeptide having the sequence of SEQ ID NO:284 and a second Fc polypeptide having the sequence of SEQ ID NO:280. In some embodiments, an anti-Tau antibody described herein comprises a first Fc polypeptide having the sequence of SEQ ID NO:285 and a second Fc polypeptide having the sequence of SEQ ID NO:281. In some embodiments, an anti-Tau antibody described herein comprises a first Fc polypeptide having the sequence of SEQ ID NO:286 and a second Fc polypeptide having the sequence of SEQ ID NO:282.

In any of the embodiments described above, the anti-Tau antibody may comprise a heavy chain CDR1-3 and a light chain CDR1-3 comprising the amino acid sequences of SEQ ID NOS:22, 23, 24, 26, 27, and 28, respectively.

In some embodiments, an anti-Tau antibody comprises a light chain having the light chain CDR1-3 (SEQ ID NOS: 26-28) and at least 85% identity, at least 90% identity, or at least 95% identity to the sequence of SEQ ID NO:315, a first heavy chain having the heavy chain CDR1-3 (SEQ ID NOS:22-24), knob (T366W according to EU numbering), LALA (L234A and L235A according to EU numbering), P329G, and/or YTE (M252Y, S254T, and T256E according to EU numbering) mutations as specified for the sequence of SEQ ID NO:317, and a second heavy chain having the heavy chain CDR1-3 (SEQ ID NOS:22-24), hole (T366S, L368A, and Y407V according to EU numbering), LALA (L234A and L235A according to EU numbering), P329G, and/or YTE (M252Y, S254T, and T256E according to EU numbering) mutations as specified for the sequence of SEQ ID NO:316. In some embodiments, an anti-Tau antibody comprises a light chain having the sequence of SEQ ID NO:315, a first heavy chain having the sequence of SEQ ID NO:317, and a second heavy chain having the sequence of SEQ ID NO:316.

In some embodiments, an anti-Tau antibody comprises a light chain having the light chain CDR1-3 (SEQ ID NOS: 26-28) and at least 85% identity, at least 90% identity, or at least 95% identity to the sequence of SEQ ID NO:315, a first heavy chain having the heavy chain CDR1-3 (SEQ ID NOS:22-24), knob (T366W according to EU numbering), LALA (L234A and L235A according to EU numbering), P329G, and/or YTE (M252Y, S254T, and T256E according to EU numbering) mutations as specified for each sequence of any one of SEQ ID NOS:317-322 and at least 85% identity, at least 90% identity, or at least 95% identity to the respective sequence, and a second heavy chain having the heavy chain CDR1-3 (SEQ ID NOS:22-24), hole (T366S, L368A, and Y407V according to EU numbering), LALA (L234A and L235A according to EU numbering), P329G, and/or YTE (M252Y, S254T, and T256E according to EU numbering) mutations as specified for each sequence of any one of SEQ ID NOS:316 and 329-333 and at least 85% identity, at least 90% identity, or at least 95% identity to the respective sequence. In some embodiments, an anti-Tau antibody comprises a light chain having the sequence of SEQ ID NO:315, a first heavy chain having the sequence of any one of SEQ ID NOS:317-322, and a second heavy chain having the sequence of any one of SEQ ID NOS:316 and 329-333.

In some embodiments, an anti-Tau antibody comprises a light chain having the light chain CDR1-3 (SEQ ID NOS: 26-28) and at least 85% identity, at least 90% identity, or at least 95% identity to the sequence of SEQ ID NO:315, a first heavy chain having the heavy chain CDR1-3 (SEQ ID NOS:22-24), hole (T366S, L368A, and Y407V according to EU numbering), LALA (L234A and L235A according to EU numbering), P329G, and/or YTE (M252Y, S254T, and T256E according to EU numbering) mutations as specified for each sequence of any one of SEQ ID NOS:323-328 and at least 85% identity, at least 90% identity, or at least 95% identity to the respective sequence, and a second heavy chain having the heavy chain CDR1-3 (SEQ ID NOS:22-

24), knob (T366W according to EU numbering), LALA (L234A and L235A according to EU numbering), P329G, and/or YTE (M252Y, S254T, and T256E according to EU numbering) mutations as specified for each sequence of any one of SEQ ID NOS:334-339 and at least 85% identity, at least 90% identity, or at least 95% identity to the respective sequence. In some embodiments, an anti-Tau antibody comprises a light chain having the sequence of SEQ ID NO:315, a first heavy chain having the sequence of any one of SEQ ID NOS:323-328, and a second heavy chain having the sequence of any one of SEQ ID NOS:334-339.

In some embodiments, an anti-Tau antibody comprises a light chain having the light chain CDR1-3 (SEQ ID NOS: 26-28) and at least 85% identity, at least 90% identity, or at least 95% identity to the sequence of SEQ ID NO:315, a first heavy chain having the heavy chain CDR1-3 (SEQ ID NOS:22-24), knob (T366W according to EU numbering), LALA (L234A and L235A according to EU numbering), P329G, and/or YTE (M252Y, S254T, and T256E according to EU numbering) mutations as specified for each sequence of any one of SEQ ID NOS:317-322 and at least 85% identity, at least 90% identity, or at least 95% identity to the respective sequence, and a second heavy chain having the heavy chain CDR1-3 (SEQ ID NOS:22-24), hole (T366S, L368A, and Y407V according to EU numbering), LALA (L234A and L235A according to EU numbering), P329G, and/or YTE (M252Y, S254T, and T256E according to EU numbering) mutations as specified for each sequence of any one of SEQ ID NOS:323-328 and at least 85% identity, at least 90% identity, or at least 95% identity to the respective sequence. In some embodiments, an anti-Tau antibody comprises a light chain having the sequence of SEQ ID NO:315, a first heavy chain having the sequence of any one of SEQ ID NOS:317-322, and a second heavy chain having the sequence of any one of SEQ ID NOS:323-328.

In some embodiments, an anti-Tau antibody comprises a light chain having the light chain CDR1-3 (SEQ ID NOS: 26-28) and at least 85% identity, at least 90% identity, or at least 95% identity to the sequence of SEQ ID NO:315, a first heavy chain having the heavy chain CDR1-3 (SEQ ID NOS:22-24), knob (T366W according to EU numbering), LALA (L234A and L235A according to EU numbering), P329G, and/or YTE (M252Y, S254T, and T256E according to EU numbering) mutations as specified for each sequence of any one of SEQ ID NOS:334-339 and at least 85% identity, at least 90% identity, or at least 95% identity to the respective sequence, and a second heavy chain having the heavy chain CDR1-3 (SEQ ID NOS:22-24), hole (T366S, L368A, and Y407V according to EU numbering), LALA (L234A and L235A according to EU numbering), P329G, and/or YTE (M252Y, S254T, and T256E according to EU numbering) mutations as specified for each sequence of any one of SEQ ID NOS:316 and 329-333 and at least 85% identity, at least 90% identity, or at least 95% identity to the respective sequence. In some embodiments, an anti-Tau antibody comprises a light chain having the sequence of SEQ ID NO:315, a first heavy chain having the sequence of any one of SEQ ID NOS:334-339, and a second heavy chain having the sequence of any one of SEQ ID NOS:316 and 329-333.

In further embodiments, an anti-Tau antibody comprises a light chain having the light chain CDR1-3 (SEQ ID NOS:26-28) and at least 85% identity, at least 90% identity, or at least 95% identity to the sequence of SEQ ID NO:315, and a heavy chain having the heavy chain CDR1-3 (SEQ ID NOS:22-24) and at least 85% identity, at least 90% identity, or at least 95% identity to the sequence of any one of SEQ ID NOS:414-419. In some embodiments, the heavy chain comprises a modified Fc polypeptide having a knob mutation (e.g., T366W according to EU numbering), hole mutations (e.g., T366S, L368A, and Y407V according to EU numbering), mutations that modulate effector function (e.g., L234A, L235A, and/or P329G (e.g., L234A and L235A) according to EU numbering), and/or mutations that increase serum stability (e.g., (i) M252Y, S254T, and T256E according to EU numbering, or (ii) N434S with or without M428L according to EU numbering).

In particular embodiments, a heavy chain having the sequence of any one of SEQ ID NOS:414-419 may be modified to contain the knob mutation T366W, mutations that modulate effector function L234A, L235A, and/or P329G (e.g., L234A and L235A), and/or mutations that incrase serum stability (i) M252Y, S254T, and T256E, or (ii) N434S with or without M428L according to EU numbering.

In particular embodiments, a heavy chain having the sequence of any one of SEQ ID NOS:414-419 may be modified to contain hole mutations T366S, L368A, and Y407V, mutations that modulate effector function L234A, L235A, and/or P329G (e.g., L234A and L235A), and/or mutations that incrase serum stability (i) M252Y, S254T, and T256E, or (ii) N434S with or without M428L according to EU numbering.

In any of the embodiments described above, the anti-Tau antibody may comprise:

(a) a heavy chain CDR1 comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOS:22, 150-154, and 420-437;

(b) a heavy chain CDR2 comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOS:23 and 438-443;

(c) a heavy chain CDR3 comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOS:24 and 155;

(d) a light chain CDR1 comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOS:26, 156-158, and 444-459;

(e) a light chain CDR2 comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:27; and (f) a light chain CDR3 comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOS:28, 159-162, and 460-462.

VIII. Therapeutic Methods Using Anti-Tau Antibodies

In another aspect, methods for the use of anti-Tau antibodies as described herein are provided. In some embodiments, an anti-Tau antibody as described in Section III above is used in the practice of the methods described herein.

In some embodiments, methods of preventing or reducing pathological Tau seeding and/or spreading are provided. In some embodiments, the method comprises inhibiting, preventing, or reducing pathological Tau seeding and/or spreading in a subject, e.g., in a brain of a subject. In some embodiments, the method comprises administering to the subject an anti-Tau antibody or antigen-binding portion thereof as described herein, a pharmaceutical composition comprising an anti-Tau antibody as described herein, or a multispecific (e.g., bispecific) antibody comprising an anti-Tau antibody as described herein. In some embodiments, the subject is an individual having a tauopathy.

In some embodiments, methods of preventing, reducing, or inhibiting Tau oligomerization are provided. In some embodiments, the method comprises preventing, reducing, or inhibiting Tau oligomerization in a subject, e.g., in a brain of a subject. In some embodiments, the method comprises administering to the subject an anti-Tau antibody or antigen-binding portion thereof as described herein, a pharmaceutical composition comprising an anti-Tau antibody as described herein, or a multispecific (e.g., bispecific) antibody comprising an anti-Tau antibody as described herein. In some embodiments, the subject is an individual having a tauopathy.

In some embodiments, methods of preventing, reducing, or inhibiting Tau aggregation are provided. In some embodiments, the method comprises preventing, reducing, or inhibiting Tau aggregation in a subject, e.g., in a brain of a subject. In some embodiments, the method comprises administering to the subject an anti-Tau antibody or antigen-binding portion thereof as described herein, a pharmaceutical composition comprising an anti-Tau antibody as described herein, or a multispecific (e.g., bispecific) antibody comprising an anti-Tau antibody as described herein. In some embodiments, the subject is an individual having a tauopathy.

In some embodiments, methods of treating a tauopathy are provided. In some embodiments, the method comprises administering to a subject having a tauopathy an anti-Tau antibody or antigen-binding portion thereof as described herein, a pharmaceutical composition comprising an anti-Tau antibody as described herein, or a multispecific (e.g., bispecific) antibody comprising an anti-Tau antibody as described herein.

In some embodiments, methods of treating a neurodegenerative disease are provided. In some embodiments, the neurodegenerative disease is a tauopathy. In some embodiments, the tauopathy is a neurodegenerative tauopathy selected from the group consisting of Alzheimer's disease, primary age-related tauopathy, progressive supranuclear palsy (PSP), frontotemporal dementia, frontotemporal dementia with parkinsonism linked to chromosome 17, argyrophilic grain dementia, amyotrophic lateral sclerosis/parkinsonism-dementia complex of Guam, corticobasal degeneration, chronic traumatic encephalopathy, Creutzfeldt-Jakob disease, dementia pugilistica, diffuse neurofibrillary tangles with calcification, Down's syndrome, familial British dementia, familial Danish dementia, Gerstmann-Straussler-Scheinker disease, globular glial tauopathy, Guadeloupean parkinsonism with dementia, Guadeloupean PSP, Hallevorden-Spatz disease, inclusion-body myositis, multiple system atrophy, myotonic dystrophy, neurofibrillary tangle-predominant dementia, Niemann-Pick disease type C, pallido-ponto-nigral degeneration, Parkinson's disease, Pick's disease, postencephalitic parkinsonism, prion protein cerebral amyloid angiopathy, progressive subcortical gliosis, subacute sclerosing panencephalitis, Huntington's disease, and tangle only dementia. In some embodiments, the neurodegenerative tauopathy is Alzheimer's disease. In some embodiments, the neurodegenerative tauopathy is frontotemporal dementia. In some embodiments, the neurodegenerative tauopathy is progressive supranuclear palsy.

In some embodiments, an anti-Tau antibody (or antigen-binding fragment, multispecific antibody, or pharmaceutical composition) as described herein is used in treating Alzheimer's disease. In some embodiments, the anti-Tau antibody is used in treating prodromal Alzheimer's disease. In some embodiments, the anti-Tau antibody is used in treating mild Alzheimer's disease (an early-stage form of the disease). In some embodiments, the anti-Tau antibody is used in treating moderate Alzheimer's disease (a middle-stage form of the disease). In some embodiments, the anti-Tau antibody is used in treating severe Alzheimer's disease (a late-stage form of the disease). In some embodiments, the anti-Tau antibody is used in treating early-onset Alzheimer's disease. In some embodiments, the anti-Tau antibody is used in treating late-onset Alzheimer's disease.

In some embodiments, the subject to be treated is a human, e.g., a human adult or a human child.

In some embodiments, the method further comprises administering to the subject one or more other therapeutic agents. In some embodiments, the method comprises administering to the subject an agent, e.g., an antibody, that binds to amyloid β peptides or prevents the aggregation of amyloid β peptides. In some embodiments, the method comprises administering to the subject an antibody against amyloid β (Aβ), including but not limited to aducanumab, bapineuzumab, solanezumab, and gantenerumab. In some embodiments, the method comprises administering to the subject a β-site Amyloid precursor protein Cleaving Enzyme 1 (BACE1) inhibitor, including but not limited to verubecestat. In some embodiments, the method comprises administering to the subject an α-synuclein antibody. In some embodiments, the method comprises administering to the subject a neuroprotective agent. In some embodiments, the neuroprotective agent is an anticholinergic agent, a dopaminergic agent, a glutamatergic agent, a histone deacetylase (HDAC) inhibitor, a cannabinoid, a caspase inhibitor, melatonin, an anti-inflammatory agent, a hormone (e.g., estrogen or progesterone), or a vitamin. In some embodiments, the method comprises administering to the subject an agent for use in treating a cognitive or behavioral symptom of a tauopathy (e.g., an antidepressant, a dopamine agonist, or an anti-psychotic).

In some embodiments, an anti-Tau antibody is administered to a subject at a therapeutically effective amount or dose. A daily dose range of about 0.01 mg/kg to about 500 mg/kg, or about 0.1 mg/kg to about 200 mg/kg, or about 1 mg/kg to about 100 mg/kg, or about 10 mg/kg to about 50 mg/kg, can be used. The dosages, however, may be varied according to several factors, including the chosen route of administration, the formulation of the composition, patient response, the severity of the condition, the subject's weight, and the judgment of the prescribing physician. The dosage can be increased or decreased over time, as required by an individual patient. In certain instances, a patient initially is given a low dose, which is then increased to an efficacious dosage tolerable to the patient. Determination of an effective amount is well within the capability of those skilled in the art.

The route of administration of an anti-Tau antibody (or antigen-binding fragment, multispecific antibody, or pharmaceutical composition) as described herein can be oral, intraperitoneal, transdermal, subcutaneous, intravenous, intramuscular, intrathecal, inhalational, topical, intralesional, rectal, intrabronchial, nasal, transmucosal, intestinal, ocular or otic delivery, or any other methods known in the art. In some embodiments, the antibody is administered orally, intravenously, or intraperitoneally.

Co-administered agents (e.g., the anti-Tau antibody and another therapeutic agent) can be administered together or separately, simultaneously or at different times. When administered, the therapeutic agents independently can be administered once, twice, three, four times daily or more or less often, as needed. In some embodiments, the administered therapeutic agents are administered once daily. In some embodiments, the administered therapeutic agents are administered at the same time or times, for instance as an admixture. In some embodiments, one or more of the therapeutic agents is administered in a sustained-release formulation.

In some embodiments, the anti-Tau antibody and another therapeutic agent are administered concurrently. In some embodiments, the anti-Tau antibody and another therapeutic agent are administered sequentially. For example, in some embodiments an anti-Tau antibody is administered first, for example for about 1, 2, 3, 4, 5, 6, 7, 8, 9, 10, 15, 20, 25, 30, 40, 50, 60, 70, 80, 90, 100 days or more prior to administering another therapeutic agent. In some embodiments, the other therapeutic agent is administered first, for example, for about 1, 2, 3, 4, 5, 6, 7, 8, 9, 10, 15, 20, 25, 30, 40, 50, 60, 70, 80, 90, 100 days or more prior to administering an anti-Tau antibody.

In some embodiments, the anti-Tau antibody (and optionally another therapeutic agent) is administered to the subject over an extended period of time, e.g., for at least 30, 40, 50, 60, 70, 80, 90, 100, 150, 200, 250, 300, 350 days or longer.

IX. Pharmaceutical Compositions and Kits

In another aspect, pharmaceutical compositions and kits comprising an antibody that specifically binds to a human Tau protein are provided. In some embodiments, the pharmaceutical compositions and kits are for use in preventing or reducing pathological Tau seeding and/or spreading, e.g., in a brain of a subject. In some embodiments, the pharmaceutical compositions and kits are for use in treating a tauopathy.

Pharmaceutical Compositions

In some embodiments, pharmaceutical compositions comprising an anti-Tau antibody are provided. In some embodiments, the anti-Tau antibody is an antibody (or antigen-binding fragment or multispecific antibody) as described in Section III above.

In some embodiments, a pharmaceutical composition comprises an anti-Tau antibody as described herein and further comprises one or more pharmaceutically acceptable carriers and/or excipients. A pharmaceutically acceptable carrier includes any solvents, dispersion media, or coatings that are physiologically compatible and that preferably does not interfere with or otherwise inhibit the activity of the active agent. Various pharmaceutically acceptable excipients are well-known in the art.

In some embodiments, the carrier is suitable for intravenous, intramuscular, oral, intraperitoneal, intrathecal, transdermal, topical, or subcutaneous administration.

Pharmaceutically acceptable carriers can contain one or more physiologically acceptable compound(s) that act, for example, to stabilize the composition or to increase or decrease the absorption of the active agent(s). Physiologically acceptable compounds can include, for example, carbohydrates, such as glucose, sucrose, or dextrans, antioxidants, such as ascorbic acid or glutathione, chelating agents, low molecular weight proteins, compositions that reduce the clearance or hydrolysis of the active agents, or excipients or other stabilizers and/or buffers. Other pharmaceutically acceptable carriers and their formulations are well-known in the art.

The pharmaceutical compositions described herein can be manufactured in a manner that is known to those of skill in the art, e.g., by means of conventional mixing, dissolving, granulating, dragee-making, emulsifying, encapsulating, entrapping or lyophilizing processes. The following methods and excipients are merely exemplary and are in no way limiting.

For oral administration, an anti-Tau antibody can be formulated by combining it with pharmaceutically acceptable carriers that are well-known in the art. Such carriers enable the compounds to be formulated as tablets, pills, dragees, capsules, emulsions, lipophilic and hydrophilic suspensions, liquids, gels, syrups, slurries, suspensions and the like, for oral ingestion by a patient to be treated. Pharmaceutical preparations for oral use can be obtained by mixing the compounds with a solid excipient, optionally grinding a resulting mixture, and processing the mixture of granules, after adding suitable auxiliaries, if desired, to obtain tablets or dragee cores. Suitable excipients include, for example, fillers such as sugars, including lactose, sucrose, mannitol, or sorbitol; cellulose preparations such as, for example, maize starch, wheat starch, rice starch, potato starch, gelatin, gum tragacanth, methyl cellulose, hydroxypropylmethyl-cellulose, sodium carboxymethylcellulose, and/or polyvinylpyrrolidone (PVP). If desired, disintegrating agents can be added, such as a cross-linked polyvinyl pyrrolidone, agar, or alginic acid or a salt thereof such as sodium alginate.

An anti-Tau antibody can be formulated for parenteral administration by injection, e.g., by bolus injection or continuous infusion. For injection, the compound or compounds can be formulated into preparations by dissolving, suspending or emulsifying them in an aqueous or nonaqueous solvent, such as vegetable or other similar oils, synthetic aliphatic acid glycerides, esters of higher aliphatic acids or propylene glycol; and if desired, with conventional additives such as solubilizers, isotonic agents, suspending agents, emulsifying agents, stabilizers and preservatives. In some embodiments, compounds can be formulated in aqueous solutions, preferably in physiologically compatible buffers such as Hanks's solution, Ringer's solution, or physiological saline buffer. Formulations for injection can be presented in unit dosage form, e.g., in ampules or in multi-dose containers, with an added preservative. The compositions can take such forms as suspensions, solutions or emulsions in oily or aqueous vehicles, and can contain formulatory agents such as suspending, stabilizing and/or dispersing agents.

In some embodiments, an anti-Tau antibody is prepared for delivery in a sustained-release, controlled release, extended-release, timed-release or delayed-release formulation, for example, in semi-permeable matrices of solid hydrophobic polymers containing the active agent. Various types of sustained-release materials have been established and are well-known by those skilled in the art. Current extended-release formulations include film-coated tablets, multiparticulate or pellet systems, matrix technologies using hydrophilic or lipophilic materials and wax-based tablets with pore-forming excipients. Sustained-release delivery systems can, depending on their design, release the compounds over the course of hours or days, for instance, over 4, 6, 8, 10, 12, 16, 20, 24 hours or more. Usually, sustained release formulations can be prepared using naturally occurring or synthetic polymers, for instance, polymeric vinyl pyrrolidones, such as polyvinyl pyrrolidone (PVP); carboxyvinyl hydrophilic polymers; hydrophobic and/or hydrophilic hydrocolloids, such as methylcellulose, ethylcellulose, hydroxypropylcellulose, and hydroxypropylmethylcellulose; and carboxypolymethylene.

Typically, a pharmaceutical composition for use in in vivo administration is sterile. Sterilization can be accomplished according to methods known in the art, e.g., heat sterilization, steam sterilization, sterile filtration, or irradiation.

Dosages and desired drug concentration of pharmaceutical compositions of the disclosure may vary depending on the particular use envisioned. The determination of the appropriate dosage or route of administration is well within the skill of one in the art. Suitable dosages are also described in Section VIII above.

Kits

In some embodiments, kits comprising an anti-Tau antibody (or antigen-binding fragment or multispecific antibody) as described herein (e.g., as described in Section III above) are provided. In some embodiments, the kits are for use in preventing or reducing pathological Tau seeding and/or spreading, e.g., in a brain of a subject. In some embodiments, the pharmaceutical compositions and kits are for use in treating a tauopathy, e.g., a neurodegenerative tauopathy.

In some embodiments, the kit further comprises one or more additional therapeutic agents. For example, in some embodiments, the kit comprises an anti-Tau antibody as described herein and further comprises one or more additional therapeutic agents for use in the treatment of a tauopathy. In some embodiments, the therapeutic agent is an agent for use in treating a cognitive or behavioral symptom of a tauopathy (e.g., an antidepressant, a dopamine agonist, or an anti-psychotic). In some embodiments, the therapeutic agent is a neuroprotective agent (e.g., an anticholinergic agent, a dopaminergic agent, a glutamatergic agent, a histone deacetylase (HDAC) inhibitor, a cannabinoid, a caspase inhibitor, melatonin, an anti-inflammatory agent, a hormone (e.g., estrogen or progesterone), or a vitamin). In some embodiments, the therapeutic agent is an agent, e.g., an antibody, that binds to amyloid 0 peptides or prevents the aggregation of amyloid peptides.

In some embodiments, the kit further comprises instructional materials containing directions (i.e., protocols) for the practice of the methods described herein (e.g., instructions for using the kit for treating a tauopathy). While the instructional materials typically comprise written or printed materials they are not limited to such. Any medium capable of storing such instructions and communicating them to an end user is contemplated by this invention. Such media include, but are not limited to electronic storage media (e.g., magnetic discs, tapes, cartridges, chips), optical media (e.g., CD-ROM), and the like. Such media may include addresses to internet sites that provide such instructional materials.

X. Examples

The present invention will be described in greater detail by way of specific examples. The following examples are offered for illustrative purposes only, and are not intended to limit the invention in any manner.

Example 1. Anti-Tau Antibody Discovery and Screening

This example describes the design, generation, and characterization of antibodies that specifically bind to multiple Tau splice isoforms and that specifically bind to both phosphorylated human Tau and unphosphorylated human Tau. The antibodies also exhibit cross-species reactivity between human Tau and cynomolgus Tau, and in some cases, mouse Tau.

A schematic for the anti-Tau antibody discovery and screening program is shown in FIG. 1. As detailed below, mice were immunized with recombinant Tau (r-Tau) and/or hyperphosphorylated Tau (p-Tau), splenocytes and lympohocytes were harvested, and RNA was extracted to generate cDNA. Subsequently, a phage library was generated by amplification of V-genes and assembly as Fab fragments fused to the phage coat protein pIII in a phagemid vector, and panned against r-Tau. Recombinant Fab fragments were then generated against r-Tau and p-Tau. Anti-Tau antibodies were selected using ELISA to screen for antibodies that bound to all of the human Tau splice isoforms 0N3R, 1N3R, 2N3R, 0N4R, 1N4R, and 2N4R and that exhibited binding to cynomolgus (cyno) Tau. Positive hits from the ELISA screens were sequenced, and the sequences were used to generate chimeric IgGs. The chimeric antibody clones were tested for binding affinity and binding characteristics and epitope mapping of high-affinity antibodies was performed.

Antigen Production

Recombinant Tau

Figure 2B:
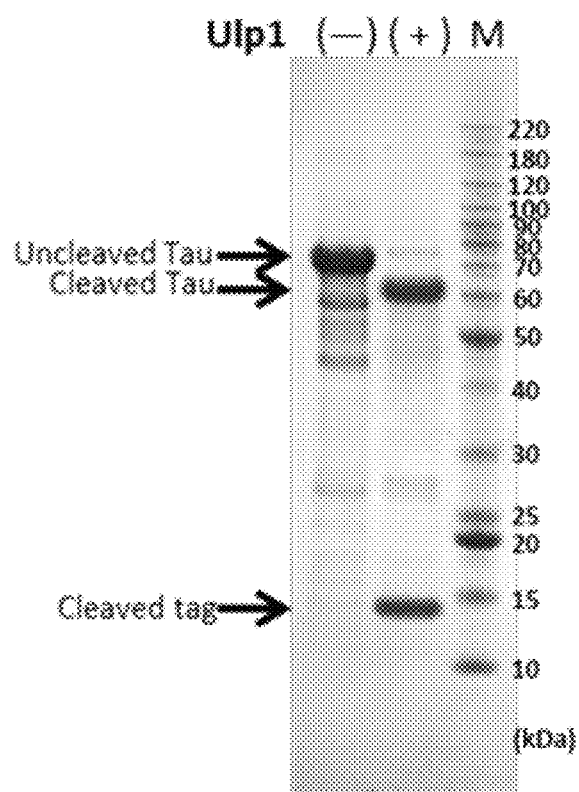
Figure 2C:
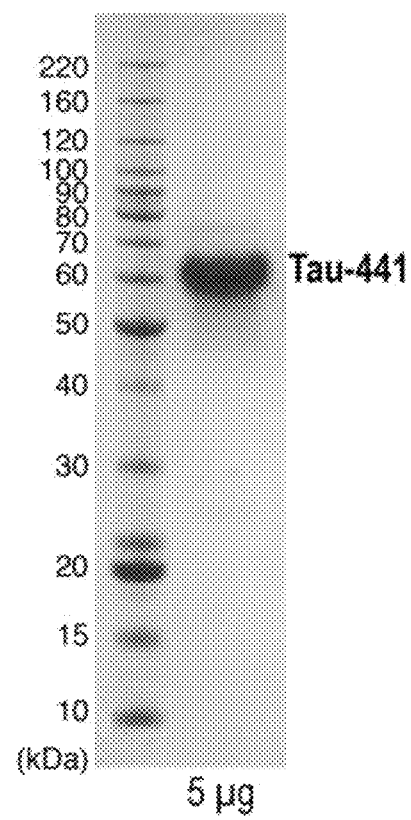

Full length (441 amino acid in length) recombinant Tau (r-Tau) was produced in *E. coli* BL21(DE3) cells. r-Tau was expressed with a His6-Smt3 tag (FIG. 2A), which was used for affinity purification and subsequently cleaved and removed using ubiquitin-like-specific protease 1 (Ulp1). FIG. 2B shows an SDS-PAGE gel of the original and cleaved product. FIG. 2C shows an SDS-PAGE gel of the final purified r-Tau antigen.

In Vitro r-Tau Phosphorylation

Figure 2D:
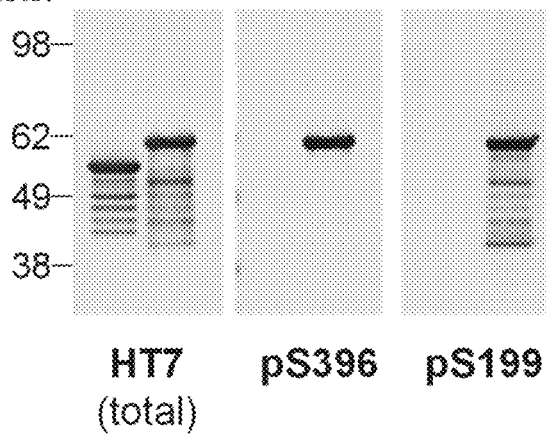
Figure 4:
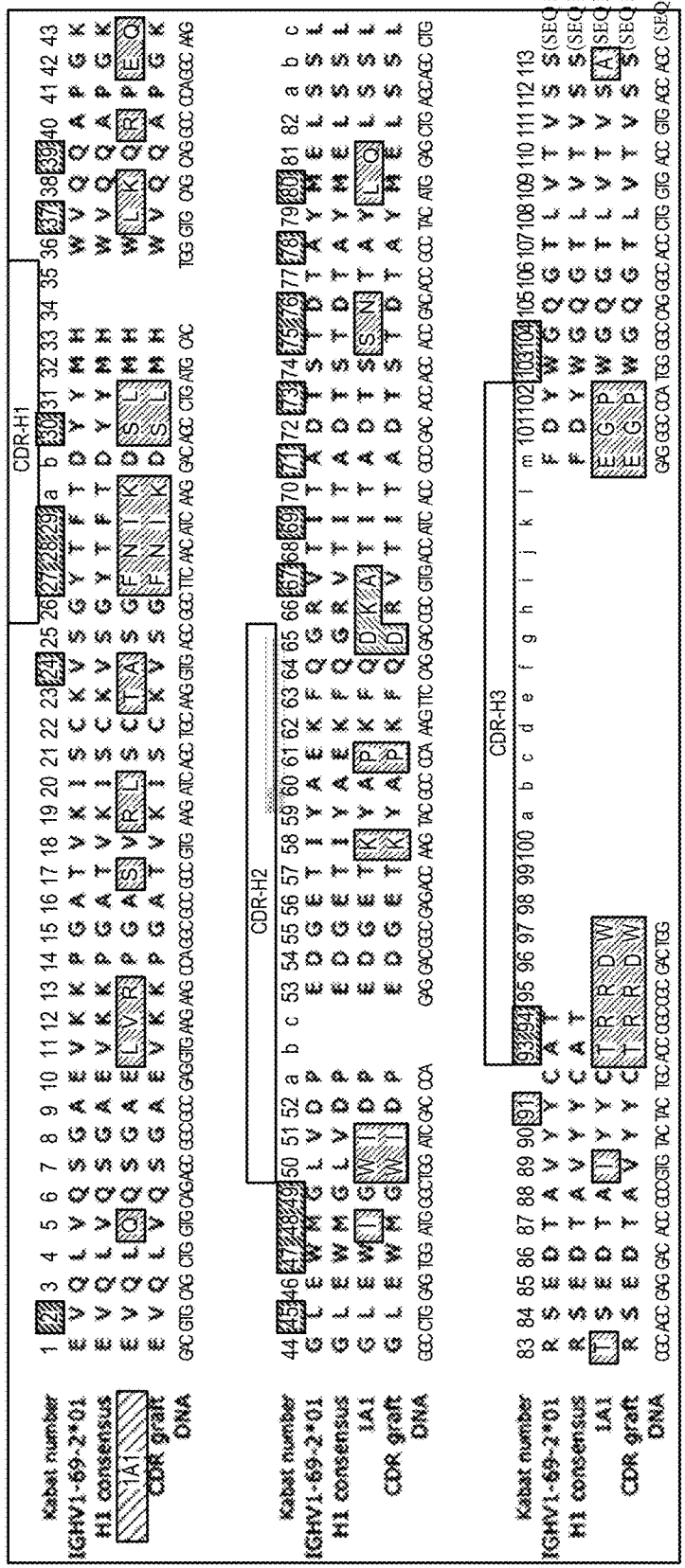
FIG. 4. Sequence alignment of clone 1A1 (SEQ ID NO:12: 1A1 VL; SEQ ID NO:8: 1A1 VH) with human immunoglobulin kappa variable 2 (IGKV2) (light chain) (SEQ ID NO:642) and immunoglobulin heavy variable 1 (IGHV1) (heavy chain) (SEQ ID NO:646) sequences. Kabat numbers that are shaded represent Vernier positions that make critical contacts within the antibody to support its interaction with the antigen. In the 1A1 sequence, amino acids that are shaded represent positions that differ with respect to the corresponding IGKV2 or IGHV1 sequences.
Figure 5:
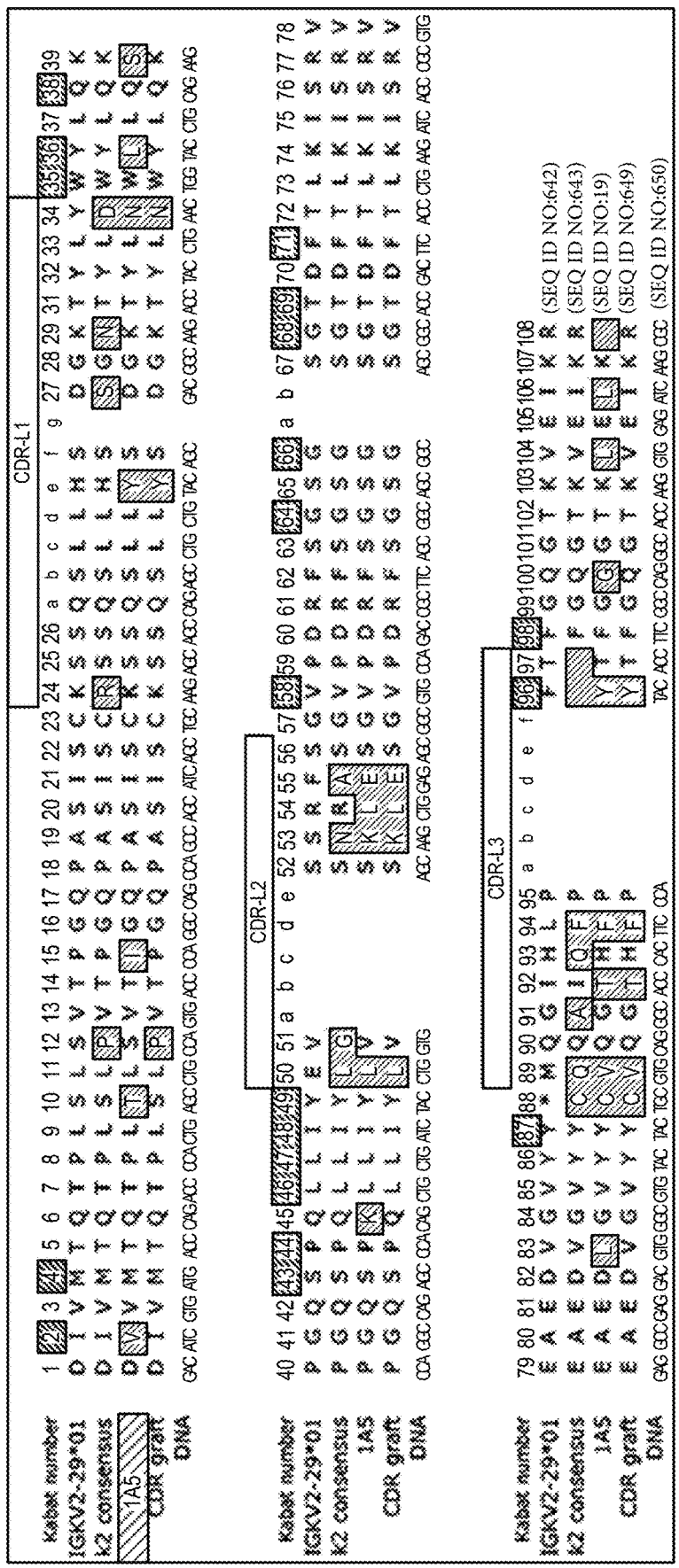
FIG. 5. Sequence alignment of clone 1A5 (SEQ ID NO:19: 1A5 VL; SEQ ID NO:16: 1A5 VH) with human immunoglobulin kappa variable 2 (IGKV2) (light chain) (SEQ ID NO:642) and immunoglobulin heavy variable 1 (IGHV1) (heavy chain) (SEQ ID NO:646) sequences. Kabat numbers that are shaded represent Vernier positions that make critical contacts within the antibody to support its interaction with the antigen. In the 1A5 sequence, amino acids that are shaded represent positions that differ with respect to the corresponding IGKV2 or IGHV1 sequences.
Figure 6:
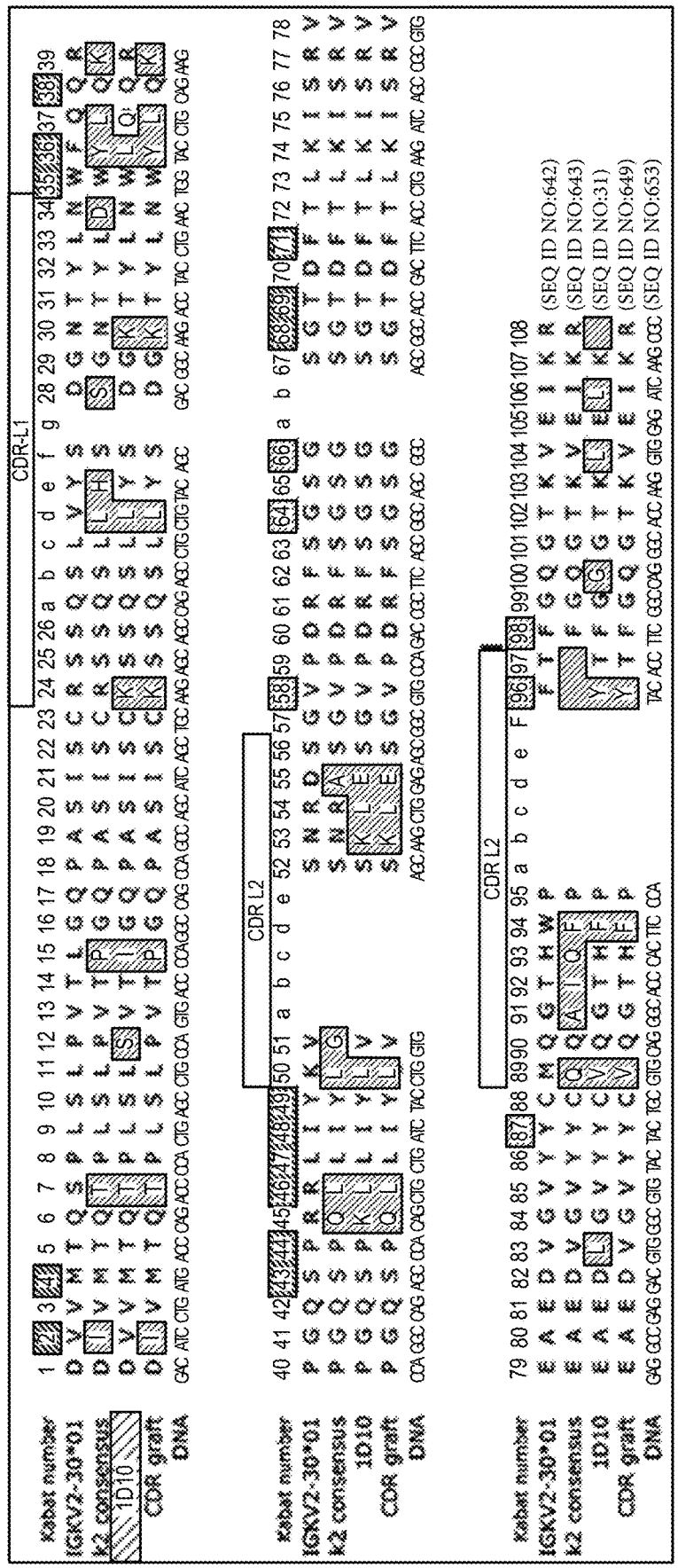
FIG. 6. Sequence alignment of clone 1D10 (SEQ ID NO:31: 1D10 VL; SEQ ID NO:29: 1D10 VH) with human immunoglobulin kappa variable 2 (IGKV2) (light chain) (SEQ ID NO:642) and immunoglobulin heavy variable 1 (IGHV1) (heavy chain) (SEQ ID NO:646) sequences. Kabat numbers that are shaded represent Vernier positions that make critical contacts within the antibody to support its interaction with the antigen. In the 1D10 sequence, amino acids that are shaded represent positions that differ with respect to the corresponding IGKV2 or IGHV1 sequences.
Figure 7:
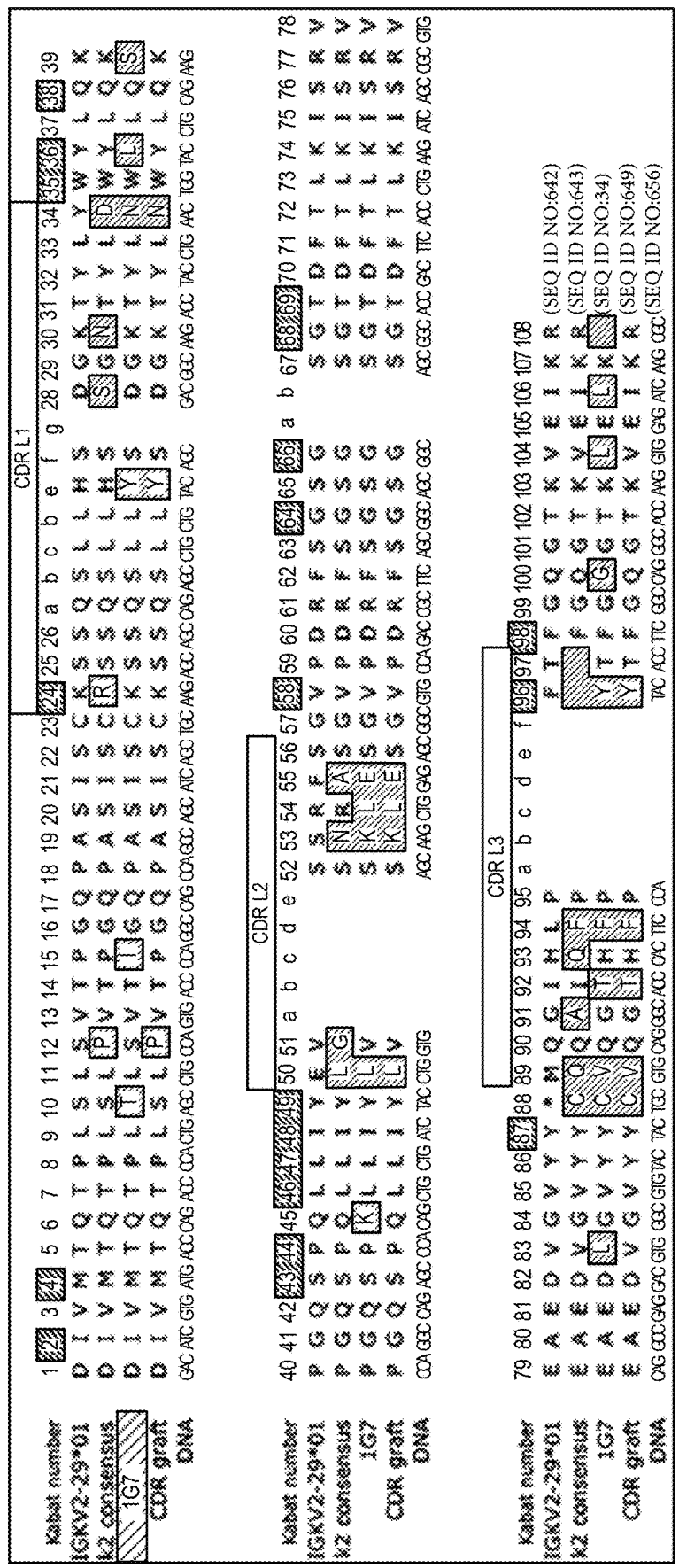
FIG. 7. Sequence alignment of clone 1G7 (SEQ ID NO:34: 1G7 VL; SEQ ID NO:32: 1G7 VH) with human immunoglobulin kappa variable 2 (IGKV2) (light chain) (SEQ ID NO:642) and immunoglobulin heavy variable 1 (IGHV1) (heavy chain) (SEQ ID NO:646) sequences. Kabat numbers that are shaded represent Vernier positions that make critical contacts within the antibody to support its interaction with the antigen. In the 1G7 sequence, amino acids that are shaded represent positions that differ with respect to the corresponding IGKV2 or IGHV1 sequences.
Figure 7:
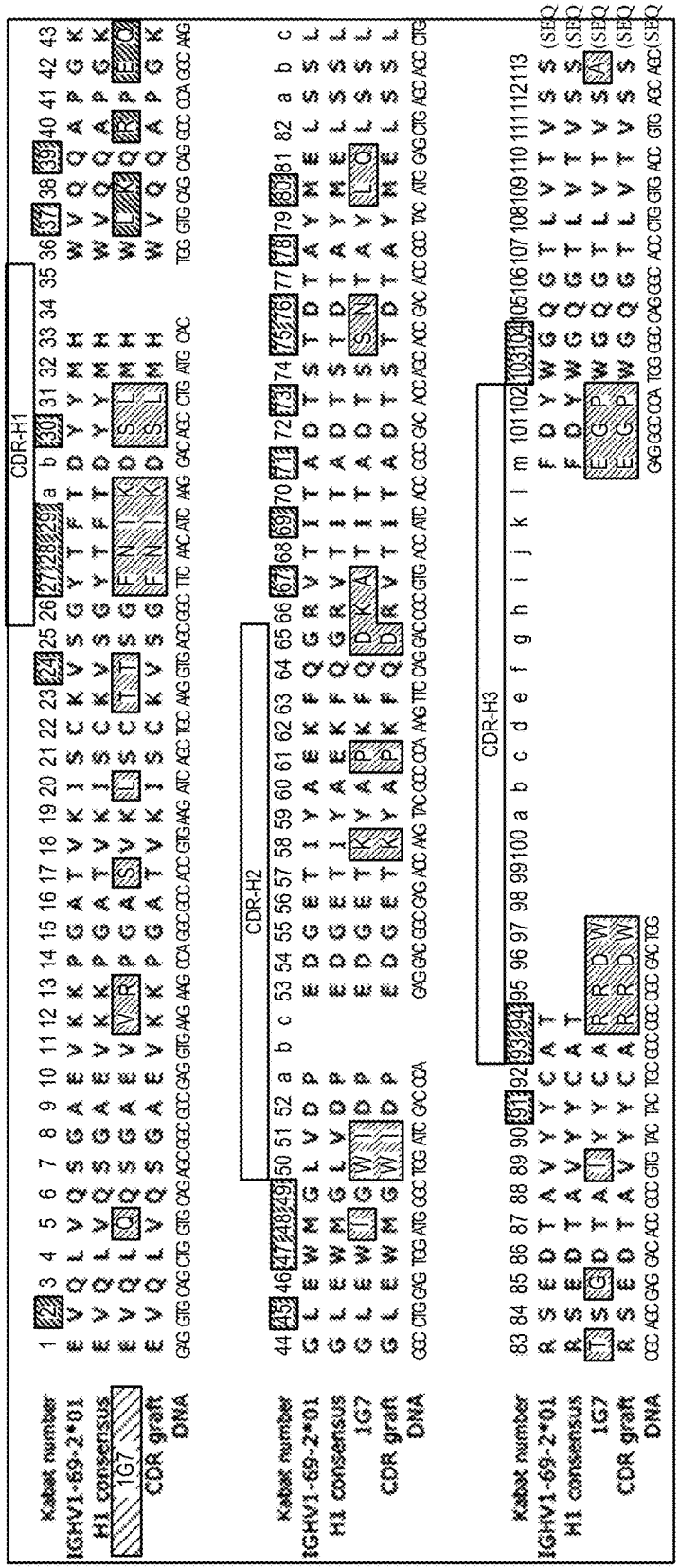

Recombinant Tau (r-Tau) was phosphorylated in vitro by incubation with 1:1 amounts of PKA and GSK3 (3 in 50 mM MES, pH 6.8, 100 mM NaCl, 0.5 mM EGTA, 5 mM MgCl2 and 1 mM ATP for 24 hours at room temperature. Phosphorylated r-Tau was then purified to remove kinases and endotoxins. Phosphorylation of r-Tau was confirmed as shown in FIG. 2D.

Immunization of Mice

NZBW mice were immunized with recombinant Tau (r-Tau), recombinant hyperphosphorylated Tau (p-Tau), or alternating injections of either antigen. Immunizations were performed via Hock or footpad weekly with 5-10 µg of antigen in Ribi or Freund's adjuvant until serum antibody against r-Tau or p-Tau reacted in an ELISA to a dilution of greater than $10^5$, typically at around six to eight weeks. Mice were given a final boost without adjuvant via intraperitoneal injection and sacrificed 3 days after the boost. Spleens and popliteal and inguinal lymph nodes were harvested, made into single cell suspensions by passing through cell strainers, and then the splenocytes and lymphocytes were flash frozen in liquid nitrogen.

Purification of RNA and generation of cDNA from splenocytes and lymphocytes

Cell pellets from frozen splenocytes or lymphocytes were thawed on ice and resuspended in 1 mL TRIzor™. The solution was incubated at room temperature for 5 minutes, then 0.2 mL of chloroform was added and the tubes were shaken vigorously for 15 seconds. The tubes were spun at 20×g for 15 minutes at 4° C. to separate the phases. The colorless aqueous phase was carefully removed leaving the white interphase and the pink chloroform phase. RNA was precipitated by addition of 0.6 mL of isopropanol, mixing by inversion, and then spinning at 20×g for 15 minutes at 4° C. The supernatant was discarded and the pellet was washed with 75% ethanol and dissolved in DEPC-treated water. cDNA was generated from the total RNA using SuperScript™ III reverse transcriptase (obtained from Thermo Fisher) using the manufacturer's recommended protocol for priming with oligo-dT.

Generation of Immunized Phage Display Libraries

PCR reactions were carried out to amplify V genes for heavy or light chain variable regions using primers specific for the respective mouse germline genes. The PCR products were purified by agarose gel. VH-CH1 fragments were generated by a joining PCR reaction using the VH products and DNA for human CH1 region along with end primers. VL-CL fragments were generated by a joining PCR reaction using the VL products and DNA for the human kappa region along with end primers. The respective fragments were purified by agarose gel. A final PCR reaction was carried out to join the VH-CH1 and VL-CL fragments, and the resulting DNA encoding Fab was again purified by agarose gel, then digested with SfiI restriction enzyme. The digested Fab fragment was ligated into the SfiI-digested phagemid vector overnight at 16° C., and the ligation product was purified by ethanol precipitation. Electrocompetent TG1 *E. coli* cells (obtained from $L_{ucigen}$®) were electroporated using a BTX® ECM® 630 electroporation system and the manufacturer's suggested parameters. For each library, four to six electroporation reactions with 0.5 μg of ligation product per reaction were performed. Immediately after each electroporation reaction, the cuvettes were washed with 2 mL of recovery media (obtained from $L_{ucigen}$®) and the TG1 cells were recovered at 37° C. with shaking for 1 hour. Selective media, 2YT containing 100 μg/mL carbenicillin (2YTC) was added, and the TG1 cells were grown to an $OD_{600}$ of approximately 0.5. M13K07 helper phage were added at an MOI of approximately 10 and infected at 37° C. for 30 minutes without shaking, followed by 30 minutes with shaking, and then 50 μg/mL kanamycin was added. The cells were grown overnight at 30° C. with shaking. Cultures were harvested by centrifugation at 8,000 rpm at a temperature of 4° C. and the pellets were discarded. PEG/NaCl (obtained from Teknova) was added to the supernatants at a final concentration of 4% PEG. The phage were precipitated on ice for 1 hour, then spun at 8,000 rpm to pellet. The supernatants were removed, and the phage were dissolved in 40 mL PBS. The solutions were centrifuged at maximum speed for 10 minutes to remove any insoluble material, then phage were precipitated a second time from the supernatant by addition of PEG/NaCl and incubation on ice. The phage were again pelleted by centrifugation and suspended in 8 mL of PBS containing 15% glycerol, then aliquoted and frozen.

Phage Panning

Phage aliquots (0.5 mL) were thawed and mixed with 0.5 mL of 10% BSA in PBS to block. The phage were added to an aliquot of 200 μL M280-streptavidin (M280SA) beads and incubated at room temperature with gentle rotation for 1 hour. Meanwhile, biotinylated r-Tau (r-Tau-biotin, 100 pmol) was added to a second aliquot of 200 μL M280SA beads and incubated at room temperature with gentle rotation for 30 minutes, then the beads were washed with PBS with 1% BSA (PBSA) three times, using a magnet to separate the beads between each wash. The phage solution was then separated from the negative M280SA beads using the magnet, and added to the r-Tau-loaded beads. After a 1 hour incubation with gentle rotation, the beads were washed four times with PBS containing 0.1% BSA and 0.05% Tween® 20, each wash lasting 5 minutes. Bound phage were eluted from the beads using 0.1 M glycine (pH 2.7) for 30 minutes; the eluted phage solution was then neutralized with 1 M Tris (pH 7.5). The eluted phage were used to infect 10 mL TG1 *E. coli* grown to mid-log phase (OD600 approximately 0.5) at 37° C. for 30 minutes without shaking, followed by 30 minutes with shaking. Selective media (2YTC) was added (40 mL volume), and the cultures were grown for 1-2 hours at 37° C. with shaking. At this point the cultures were at $OD_{600}$ of 0.5 or lower, and were infected with M13K07 helper phage at an MOI of approximately 10. After infection, 50 μg/mL kanamycin was added and the cultures were grown overnight at 30° C. with shaking. For the second panning round, phage were precipitated once with PEG/NaCl and concentrated 20-fold, then the same protocol as above was followed, except that more stringent washing was performed (6×PBST washes, 2 for 10 minutes). After the second panning round, infected TG1 cells were spread onto 2YTCG plates (obtained from Teknova) for picking of single colonies for screening.

Generating Fabs Via Periplasmic Expression

Single colonies from the second panning round output were picked and placed into 96-well deep-well plates containing 0.5 mL of 2YTC media. The plates were sealed and grown overnight at 37° C. with shaking. To induce periplasmic Fab expression, 50 μL of the overnight culture was transferred to new 96-well deep-well plates containing 950 μL per well of 2YTC media with auto-induction supplements (obtained from EMD Millipore). The plates were sealed and grown overnight at 37° C. The plates were centrifuged at 4,000 rpm for 10 minutes to pellet the bacteria and the media was discarded. The pellets were suspended in 0.1 mL of PPB buffer (obtained from Teknova) and shaken at 10° C. and 1,000 rpm for one hour, after which 0.3 mL of water was added to each well. After an additional 30 minutes of shaking, the plates were spun at maximum speed for 10 minutes. The resulting supernatant contained soluble, crude Fab for screening.

Screening Fabs for Binding to r-Tau and p-Tau

Half-area ELISA plates (Costar™) were coated overnight at 4° C. with 25 μL per well of 0.5 μg/mL r-Tau or p-Tau. The plates were washed three times with PBST using a BioTek® plate washer. The plates were then blocked for one hour at room temperature with 100 μL per well of PBSA. After washing three times with PBST, the periplasmically-expressed Fabs were added (25 per well) and the plates were incubated for one hour. The plates were subsequently washed three times with PBST, and 25 μL per well of PBSA containing a 1:5,000 dilution of HRP-conjugated rabbit anti-human kappa (obtained from Bethyl Laboratories) was added. The plates were incubated at room temperature for 30 minutes, then washed three times with PBST. The plates were developed by adding 25 μL per well of TMB substrate (obtained from Thermo Fisher) and quenched with 2N H2SO4. The signal was quantified on a BioTek® plate reader at A450. Wells with signal greater than 5-fold over background for both r-Tau and p-Tau were considered positive and the clones were re-arrayed from the primary culture for confirmation of binding (by repeat of ELISA) and sequencing of the variable regions.

Screening Fabs for Isoform and Species Specificity

ELISAs were performed essentially as described above, but coating was performed using 1 μg/mL of each recombinant Tau species and using a 1:1 dilution (in PBS with 0.1% BSA, 0.05% Tween®) of Fab containing supernatant. The results of the ELISAs, showing Fab binding to cyno Tau and mouse Tau, as well as binding to phosphorylated full-length human Tau and the human Tau isoforms, are shown in Table 1 below.

solution. The signal was quantified using a BioTek® plate reader at A650 and binding curves were plotted with PRISM software.

Figure 8:
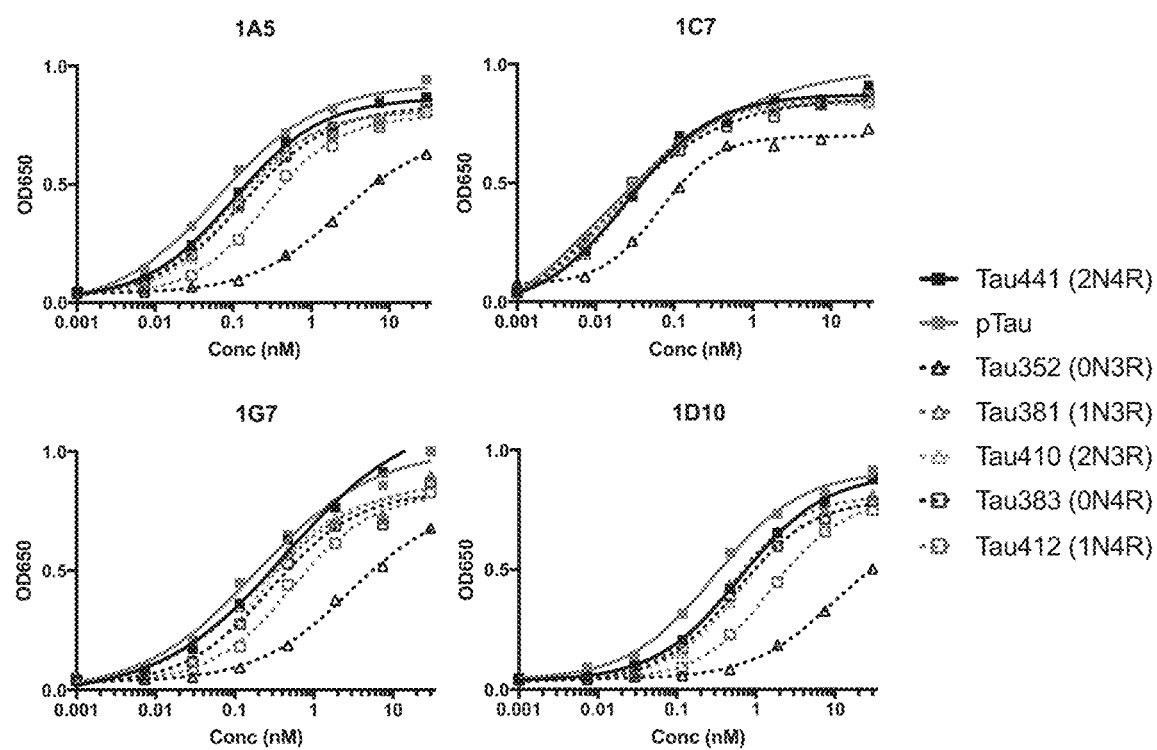
FIG. 8. ELISAs of chimeric IgG antibodies 1A5, 1C7, 1G7, and 1D10 analyzing binding of the antibodies to all splice isoforms of human Tau (Tau441 (2N4R), Tau352 (0N3R), Tau381 (1N3R), Tau410 (2N3R), Tau383 (0N4R), and Tau412 (1N4R)) and to hyperphosphorylated Tau441 (p-Tau).
Figure 9A:
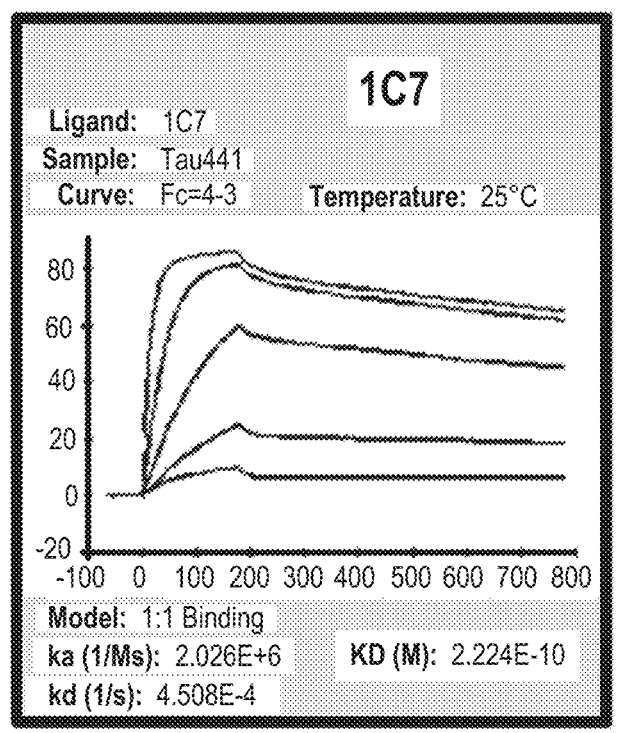
FIGS. 9A-9E. Biacore™ analysis of chimeric IgG binding to full-length human Tau (Tau441) for antibodies 1C7 (A), 1A1 (B), 1A5 (C), 1D10 (D), and 1G7 (E).
Figure 9B:
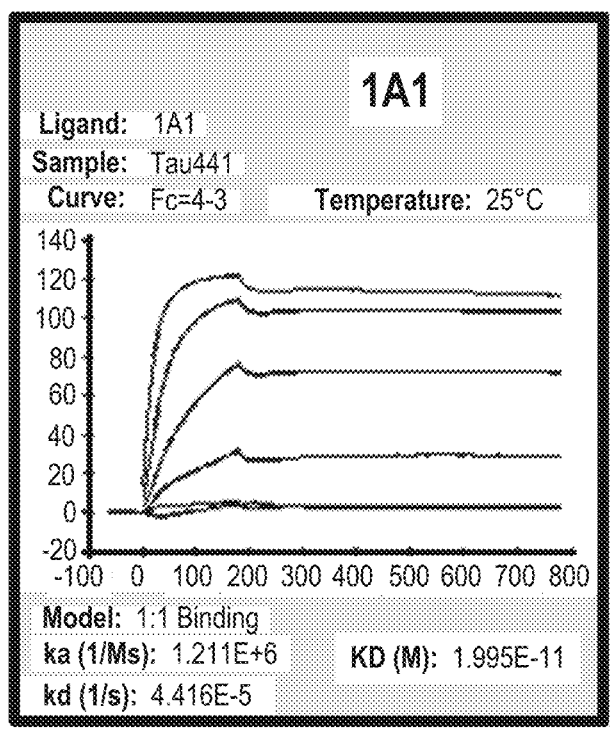
Figure 9E:
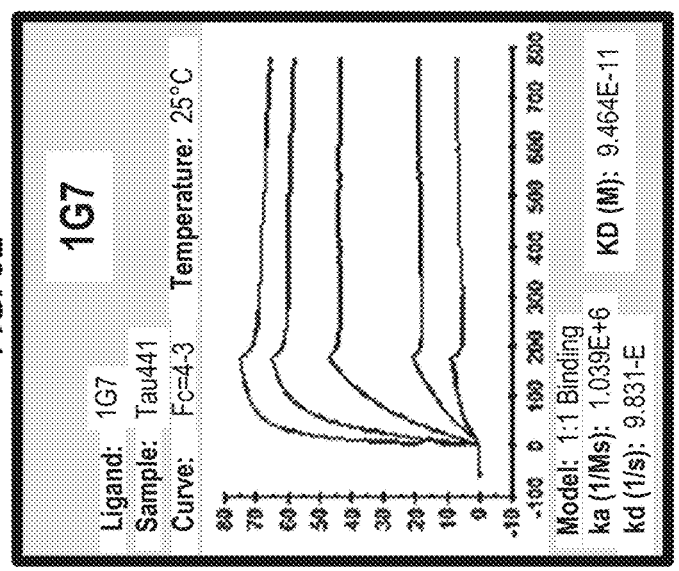
Figure 9D:
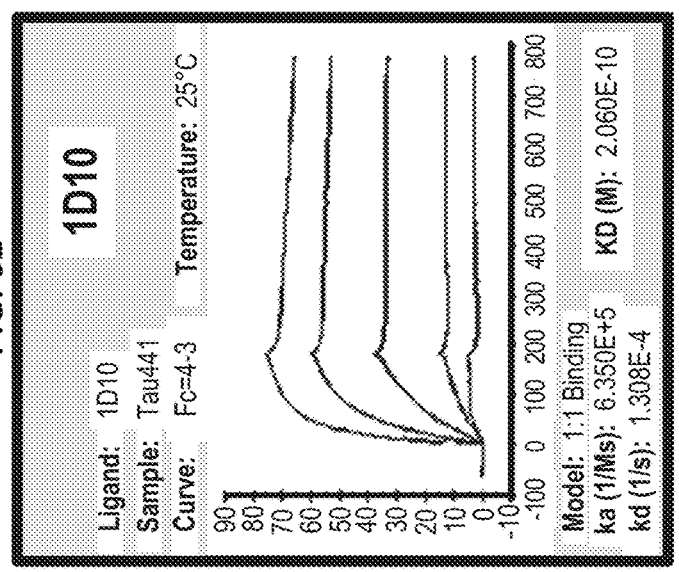
Figure 9C:
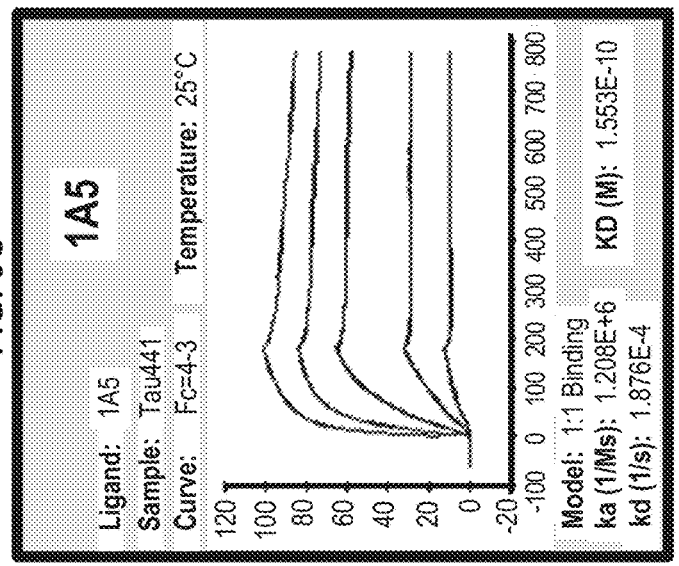

FIG. 8 depicts the results of ELISAs in which four chimeric IgG clones (clones 1A5, 1C7, 1G7, and 1D10) were tested for binding to full-length human Tau (Tau441 (2N4R)), hyperphosphorylated Tau441 (p-Tau), and the other five splice isoforms of human Tau (Tau352 (0N3R), Tau381 (1N3R), Tau410 (2N3R), Tau383 (0N4R), and

TABLE 1

Fab screening of human Tau isoforms and species specificity

| | 0N3R | | 0N4R | | 1N3R | | 1N4R | | 2N3R | | 2N4R | |
|---|---|---|---|---|---|---|---|---|---|---|---|---|
| | $A_{450}$ | avg. | $A_{450}$ | avg. | $A_{450}$ | avg. | $A_{450}$ | avg. | $A_{450}$ | avg. | $A_{450}$ | avg. |
| 1A1 | 1.658 | 1.539 | 2.390 | 2.368 | 2.571 | 2.586 | 2.468 | 2.390 | 2.590 | 2.520 | 2.583 | 2.502 |
| | 1.420 | | 2.347 | | 2.600 | | 2.312 | | 2.450 | | 2.421 | |
| 1C7 | 2.472 | 2.403 | 2.660 | 2.658 | 2.704 | 2.696 | 2.731 | 2.688 | 2.775 | 2.747 | 2.735 | 2.734 |
| | 2.334 | | 2.657 | | 2.688 | | 2.645 | | 2.719 | | 2.734 | |
| 1A5 | 1.266 | 1.191 | 2.461 | 2.482 | 2.622 | 2.582 | 2.302 | 2.328 | 2.580 | 2.541 | 2.570 | 2.570 |
| | 1.115 | | 2.504 | | 2.541 | | 2.353 | | 2.503 | | 2.569 | |
| 1D10 | 0.331 | 0.323 | 1.211 | 1.186 | 1.505 | 1.486 | 0.967 | 0.939 | 1.467 | 1.462 | 1.541 | 1.472 |
| | 0.316 | | 1.162 | | 1.467 | | 0.911 | | 1.457 | | 1.403 | |
| 1G7 | 0.746 | 0.725 | 2.123 | 1.877 | 2.220 | 2.159 | 1.840 | 1.799 | 2.056 | 2.002 | 2.126 | 2.044 |
| | 0.705 | | 1.632 | | 2.098 | | 1.757 | | 1.948 | | 1.962 | |

| | 1-421 (2N4R) | | 50-441 (2N4R) | | p-Tau (2N4R) | | cyno Tau | | mouse Tau | |
|---|---|---|---|---|---|---|---|---|---|---|
| | $A_{450}$ | avg. | $A_{450}$ | avg. | $A_{450}$ | avg. | $A_{450}$ | avg. | $A_{450}$ | avg. |
| 1A1 | 1.485 | 1.524 | 1.683 | 1.796 | 2.120 | 2.094 | 1.729 | 1.807 | 1.832 | 1.953 |
| | 1.563 | | 1.910 | | 2.067 | | 1.886 | | 2.074 | |
| 1C7 | 2.033 | 2.121 | 2.041 | 2.303 | 2.142 | 2.238 | 2.246 | 2.311 | 0.060 | 0.060 |
| | 2.210 | | 2.565 | | 2.334 | | 2.376 | | 0.060 | |
| 1A5 | 1.491 | 1.638 | 1.898 | 2.083 | 1.953 | 2.080 | 1.766 | 1.898 | 1.961 | 2.069 |
| | 1.786 | | 2.267 | | 2.207 | | 2.030 | | 2.176 | |
| 1D10 | 0.738 | 0.806 | 1.053 | 1.128 | 1.111 | 1.191 | 0.862 | 0.867 | 1.022 | 1.099 |
| | 0.875 | | 1.204 | | 1.270 | | 0.872 | | 1.175 | |
| 1G7 | 1.121 | 1.227 | 1.594 | 1.679 | 1.411 | 1.610 | 1.412 | 1.526 | 1.415 | 1.508 |
| | 1.332 | | 1.764 | | 1.809 | | 1.641 | | 1.601 | |

Antibody Generation

AntiTau antibodies were expressed as mouse-human chimeric antibodies by HEK293 cell transient transfection. IgGs were purified with protein A affinity chromatography.

FIG. 3 through FIG. 7 depict sequence alignments for antibody clones 1C7, 1A1, 1A5, 1D10, and 1G7 aligned against human light chain (immunoglobulin kappa variable 4 (IGKV4) or immunoglobulin kappa variable 2 (IGKV2)) and heavy chain (immunoglobulin heavy variable 3 (IGHV3) or immunoglobulin heavy variable 1 (IGHV1)) sequences. For the alignments, CDR definitions were defined by their sequence hypervariability.

Chimeric IgG ELISA

NuncR MaxiSorp microtiter plates were coated with 1 μg/ml of recombinant Tau, p-Tau, or Tau isoforms. The plates were washed three times with PBST using a BioTek® plate washer and blocked with 200 μL per well of PBSA for 1 hour at room temperature. Serial 4-fold dilutions of each chimeric IgG antibody were incubated in each well for 1 hour at room temperature. The plates were subsequently washed three times with PBST, and 60 μL per well of PBSA containing a 1:1,000 dilution of HRP-conjugated goat anti-human IgG Fc secondary antibody was added. The plates were incubated at room temperature for 30 minutes, then washed three times with PBST. The plates were developed by adding 60 μL per well of TMB substrate (obtained from Thermo Fisher) and quenched with the 650 nm ELISA stop Tau412 (1N4R)). As shown in FIG. 8, all of the clones bound to both unphosphorylated full-length Tau and p-Tau. In addition, all clones bound to the remaining splice isoforms 0N3R, 1N3R, 2N3R, 0N4R, and 1N4R.

The chimeric IgG clones 1A5, 1C7, 1G7, and 1D10 were also tested for cross-species reactivity to mouse Tau (SEQ ID NO:6) and cyno Tau (SEQ ID NO:7) in an ELISA assay. All four clones exhibited comparable binding to cyno Tau as to human full-length Tau. The 1A5, 1G7, and 1D10 clones also exhibited binding to mouse Tau. The four chimeric IgG clones were also tested for binding to C-terminal truncated human Tau (Tau(1-421); SEQ ID NO:4) and N-terminal truncated human Tau (Tau(50-441); SEQ ID NO:5). It was found that all of the tested clones bound to Tau within amino acid residues 50-421 of SEQ ID NO:1.

Epitope Binning for Selected Antibodies

Epitope binning assays were performed using a ForteBio Octet RED384 instrument using FortéBio® Streptavidin biosensors. Biotinylated recombinant Tau was diluted to a concentration of 2 μg/mL in kinetic buffer (obtained from FortéBio®) and captured onto individual biosensors for 1 minute. A baseline was then established for 1 minute in kinetic buffer. The loaded biosensors were dipped into 10 μg/mL of the first chimeric IgG antibody until signal saturation, followed by dipping into 1 μg/mL of a second antibody. The binding for the second antibody was normalized to its total binding in the absence of the first antibody.

Results of the binning assays are summarized below in Table 2, which shows that clones 1A5, 1G7, and 1D10 binned together, while clone 1C7 belonged to a separate bin.

TABLE 2

Epitope binning of chimeric IgG clones

|       | 1C7  | 1A5   | 1G7   | 1D10  |
|-------|------|-------|-------|-------|
| 1C7   | 0.03 | 0.88  | 0.84  | 0.82  |
| 1A5   | 0.70 | −0.13 | −0.10 | −0.35 |
| 1G7   | 0.85 | −0.04 | −0.03 | −0.12 |
| 1D10  | 0.88 | −0.07 | 0.12  | −0.05 |
| Ab107 | 1.00 | 1.00  | 1.00  | 1.00  |

Biacore Assessment of Selected Anti-Tau Antibodies

The affinity of chimeric IgG antibodies 1C7, 1A1, 1A5, 1D10, and 1G7 for recombinant Tau was determined by surface plasmon resonance using a Biacore™ T200 instrument. Biacore™ Series S CM5 sensor chips were immobilized with monoclonal mouse anti-human IgG (Fc) antibody (human antibody capture kit from GE Healthcare). 1 µg/mL of antibody was captured for 1 minute on each flow cell and serial 3-fold dilutions of recombinant Tau were injected at a flow rate of 30 µL/min. Each sample was analyzed with a 3-minute association and a 10-minute dissociation. After each injection the chip was regenerated using 3M MgCl$_2$. Binding response was corrected by subtracting the RU from a flow cell capturing an irrelevant IgG at similar density. A 1:1 Languir model of simultaneous fitting of $k_{on}$ and $k_{off}$ was used for kinetics analysis.

As shown in FIGS. 9A through 9E, clones 1C7, 1A1, 1A5, 1D10, and 1G7 all exhibited fast on-rates and very slow off-rates, consistent with strong affinity for recombinant Tau.

Table 3 below shows binding properties of clones 1C7, 1A5, 1G7, 1A1, and 1D10, including their sub-nanomolar affinity for recombinant human Tau as measured by Biacore, their binding specificity for cyno and mouse Tau, and the epitope or epitopes recognized by each antibody.

TABLE 3

Binding properties of antibody clones

| Clone | Binding to Cyno Tau (yes/no) | Binding to Mouse Tau (yes/no) | Affinity for r-Tau (nM) | Epitope(s) Recognized by Antibody |
|-------|------|------|------|-----------------|
| 1C7   | Y    | N    | 0.20 | 111-125         |
| 1A5   | Y    | Y    | 0.20 | 256-270 and 346-360 |
| 1G7   | Y    | Y    | 0.10 | 256-270 and 346-360 |
| 1A1   | Y    | Y    | 0.02 | 256-270 and 346-360 |
| 1D10  | Y    | Y    | 0.20 | 256-270 and 346-360 |

Epitope Mapping Using Peptide Microarrays

Full length human Tau (encoded by the microtubule-associated protein Tau isoform 2 gene (MAPT), amino acid sequence NCBI Reference Sequence No. NP_005901.2, SEQ ID NO:1, variant designation "2N4R") was divided into 15 amino acid peptides, offset by 5 amino acids (overlapping by 10 amino acids). Peptides were synthesized and covalently attached to silica slides in triplicate with a spot size of 0.5 mm (obtained from JPT Technologies, Berlin, Germany). Chimeric IgG antibodies were diluted to a concentration of 5 µg/mL in 3% bovine serum albumin in Tris-buffered saline (10 mM Tris, pH 7.5, 150 mM NaCl) supplemented with 0.05% Tween® 20 (3% BSA-TBST). Diluted antibodies were allowed to bind to peptides printed onto slides for 2 hours at room temperature as described in the PepStar™ user manual (JPT Technologies). Following extensive washing (5×5 minutes with TBST), slides were incubated with secondary antibodies goat anti-human IgG, Alexa Fluor® 568 conjugate, 1 µg/mL in 3% BSA-TBST) for 1 hour at room temperature. After extensive washing, (5×5 minutes with TBST, then 5×5 minutes with ultrapure water), slides were dried overnight and imaged using an Opera Phenix™ system in the 568 nm channel. Images were aligned to peptide array definition files using Galviewer software obtained from JPT Technologies and ImageJ software with control human IgG serving as landmarks.

The results of the epitope mapping are shown in FIG. 10 and Table 12 below. FIG. 10A depicts that clone 1C7 binds to a peptide corresponding to residues 111-125 of SEQ ID NO:1, indicating that residues 111-125 are sufficient for the antibody to bind to Tau. FIG. 10B shows that 1A1 binds to peptides corresponding to residues 251-265 and residues 256-270 of SEQ ID NO:1, with the strongest binding occurring within residues 256-270, indicating that residues 251-265 or residues 256-270 are sufficient for the antibody to bind to Tau. FIG. 10B also shows that 1A1 binds to a peptide corresponding to residues 346-360 of SEQ ID NO:1, indicating that residues 346-360 are sufficient for the antibody to bind to Tau. Clones 1A5, 1G7, and 1D10 showed identical peptide binding profiles as clone 1A1.

Epitope Confirmation and Phosphorylation Study

Peptides corresponding to original binding sites on the microarray were synthesized and included all permutations of phospho-serine epitopes. Peptides were synthesized with a biotinylated N-terminus and C-terminal amide. Peptides were purified and confirmed by mass spectrometry. Peptides were then bound to streptavidin-coated plates in half serial dilutions from 250 ng/well of each peptide. Antibody binding was tested at 1 µg/mL in 5% BSA TBST, followed by washing and detection with goat anti-human HRP (as described above in the "Chimeric IgG ELISA" section).

Figure 11:
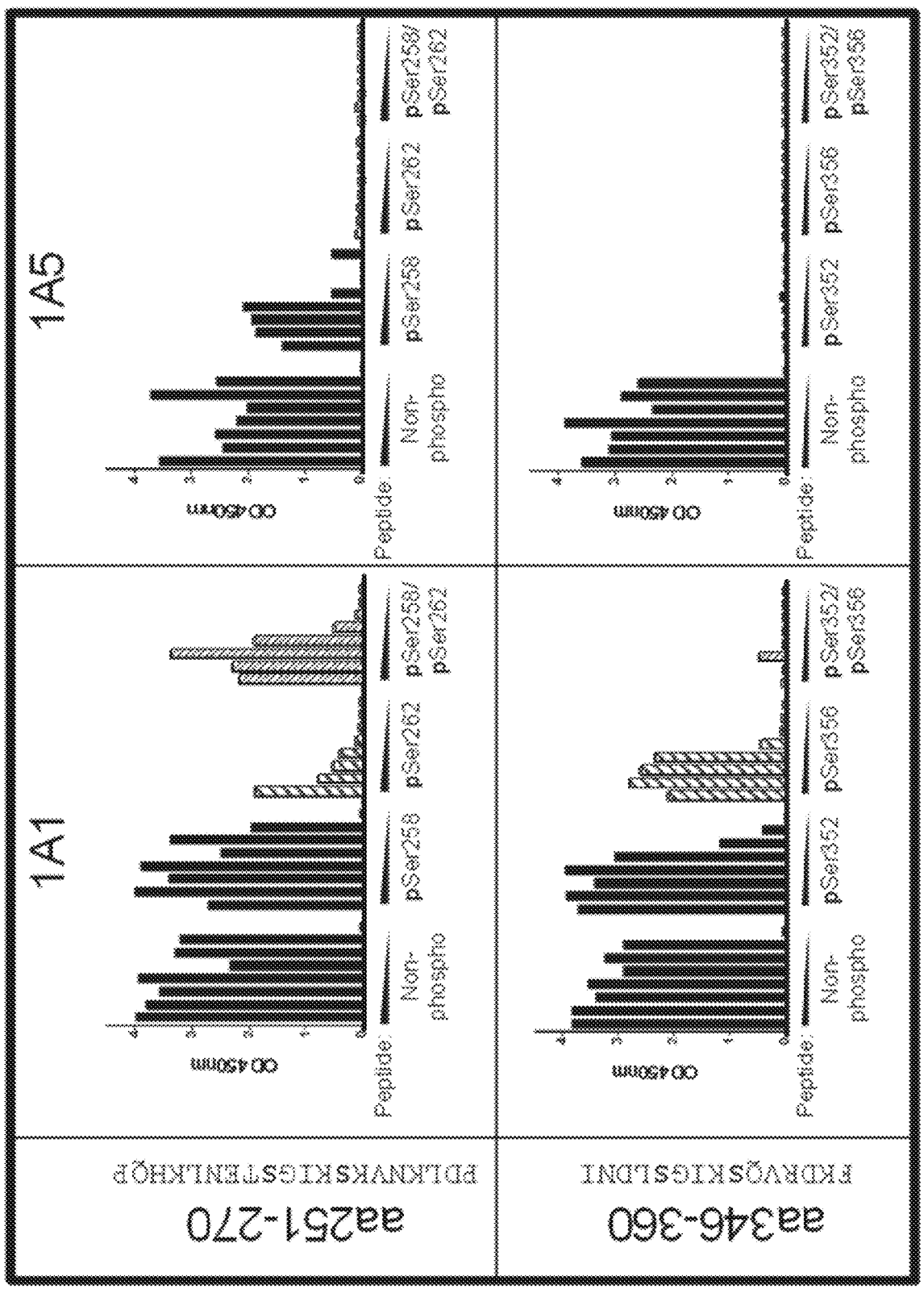
FIG. 11. Epitope confirmation of chimeric IgG clones 1A1, 1A5, 1D10, and 1G7 and phosphorylation analysis. Upper panel: Peptide corresponding to amino acids 251-270 of SEQ ID NO:1. Four different peptides corresponding to the 251-270 epitope of SEQ ID NO:1 were tested: an unphosphorylated peptide, a peptide phosphorylated at the serine in position 258 (pSer258), a peptide phosphorylated at the serine in position 262 (pSer262), and a peptide having both pSer258 and pSer262. Lower panel: Peptide corresponding to amino acids 346-360 of SEQ ID NO:1. Four different peptides corresponding to the 346-360 epitope of SEQ ID NO:1 were tested: an unphosphorylated peptide, a peptide phosphorylated at the serine in position 352 (pSer352), a peptide phosphorylated at the serine in position 356 (pSer356), and a peptide having both pSer352 and pSer356. For each assay, peptides were analyzed at dilutions of 250, 125, 63.5, 31.25, 15.6, 7.8, 3.9, and 0 ng (from left to right).
Figure 11:
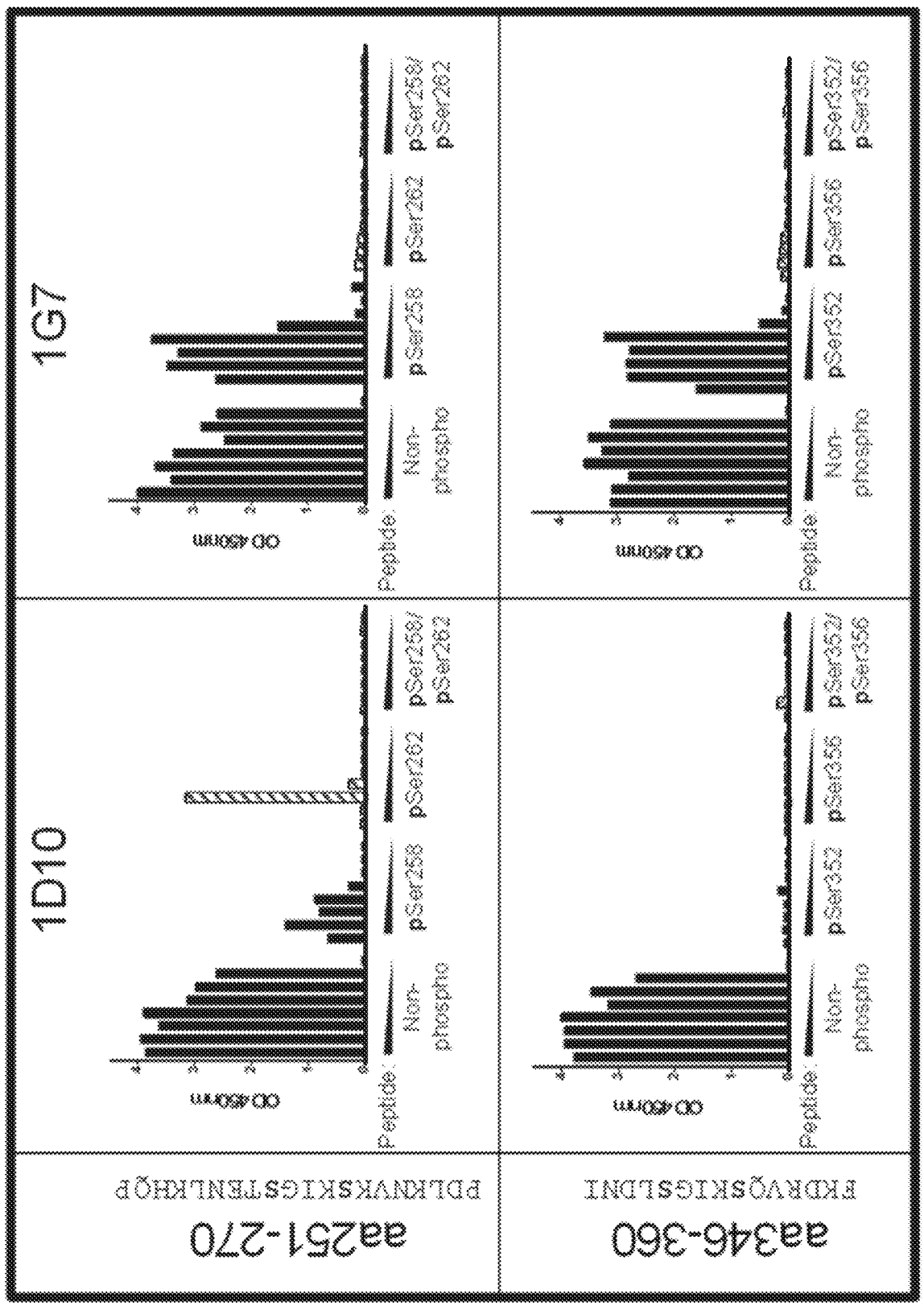

FIG. 11 shows the results of an epitope confirmation and phosphorylation study for clones 1A1, 1A5, 1D10, and 1G7. For the epitope 251-270, antibody binding was measured for an unphosphorylated PDLKNVKSKIGSTENLKHQP (SEQ ID NO:36) peptide, a PDLKNVKSKIGSTENLKHQP (SEQ ID NO:36) peptide phosphorylated at either Ser258 or Ser262, or a PDLKNVKSKIGSTENLKHQP (SEQ ID NO:36) peptide phosphorylated at both Ser258 and Ser262. See, FIG. 11, top panel. All of the 1A1, 1A5, 1D10, and 1G7 antibodies exhibited strong binding to both the unphosphorylated peptide, confirming that these antibodies recognize the 251-270 epitope. Additionally, all of the 1A1, 1A5, 1D10, and 1G7 antibodies exhibited strong binding to at least one monophosphorylated peptide. 1A1 also exhibited strong binding to the peptide that was phosphorylated at both Ser258 and Ser262.

For the epitope 346-360, antibody binding was measured for an unphosphorylated FKDRVQSKIGSLDNI (SEQ ID NO:38) peptide, a FKDRVQSKIGSLDNI (SEQ ID NO:38) peptide phosphorylated at either Ser352 or Ser356, or a FKDRVQSKIGSLDNI (SEQ ID NO:38) peptide phosphorylated at both Ser352 and Ser356. See, FIG. 11, bottom panel. All of the 1A1, 1A5, 1D10, and 1G7 antibodies exhibited strong binding to both the unphosphorylated peptide, confirming that these antibodies recognize the 346-360 epitope. Additionally, the 1A1 antibody exhibited strong binding to each of the monophosphorylated peptides, while the 1G7 antibody exhibited strong binding to one of the monophosphorylated peptides (pSer352).

Example 2. Functional Characterization of Anti-Tau Antibodies

This example illustrates that anti-Tau antibodies as described herein are able to bind to soluble Tau in both control and Alzheimer's disease brain lysate samples, and that the antibodies inhibit Tau seeding by human brain lysate.

Human Brain Lysate Binding

Control and Alzheimer's disease brain samples were obtained from Banner Health®. Samples were sectioned and one approximately 30 mg section was homogenized in five volumes (w/v) of cold PBS (with protease and phosphatase inhibitors) using a 3 mm bead in a 2 mL tube and a tissue lyzer (3 minutes at 25/s×2). The resulting lysate was then centrifuged at 3,000×g for 10 minutes at 4° C. and the supernatant was collected as the soluble fraction. Pierce™ BCA protein assays and human Tau ELISAs (obtained from Life Technologies) were performed according to the manufacturers' protocols to determine total protein and total Tau levels, respectively.

ELISAs were performed using chimeric IgG antibodies 1C7 and 1A1 as described in Example 1 above, except with a coating of 50 μL of soluble brain lysate containing 100 ng/mL of total Tau protein diluted in PBS (with protease and phosphatase inhibitors) overnight at 4° C. As shown in Table 4 below, antibody clones 1C7 and 1A1 were able to bind soluble Tau in lysate samples obtained from control and Alzheimer's disease brain tissue at both concentrations of antibody that were tested (0.5 and 5 nM). An anti-RSV antibody was used a negative control.

TABLE 4

Binding to soluble Tau in control and Alzheimer's disease samples

|  | nM | Control | | | | AD | |
|---|---|---|---|---|---|---|---|
| Control | 0.5 | 0.147 | 0.106 | 0.108 | 0.108 | 0.117 | 0.115 |
|  | 5 | 0.151 | 0.107 | 0.110 | 0.108 | 0.107 | 0.117 |
| 1C7 | 0.5 | 2.724 | 2.565 | 2.614 | 2.602 | 2.450 | 2.568 |
|  | 5 | 2.708 | 2.682 | 2.696 | 2.696 | 2.579 | 2.728 |
| 1A1 | 0.5 | 2.208 | 1.687 | 1.772 | 1.769 | 1.695 | 1.738 |
|  | 5 | 2.734 | 2.576 | 2.567 | 2.513 | 2.535 | 2.697 |

Tau Seeding Assay

Figure 12A:
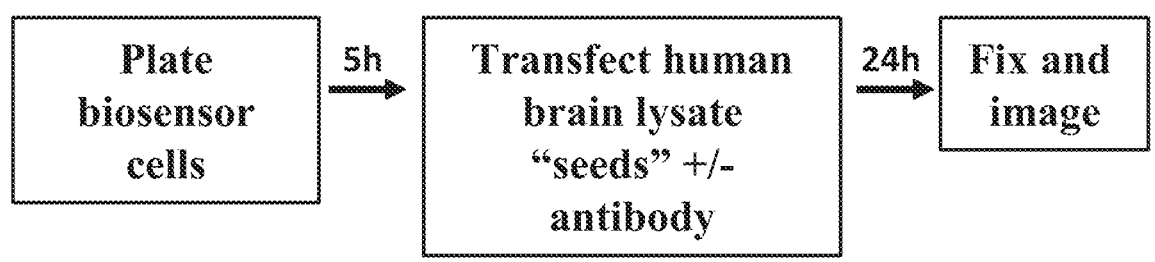
FIGS. 12A and 12B. Chimeric IgG clones 1A1 and 1C7 inhibit Tau seeding by human brain lysate. (A) Tau FRET biosensor cells are plated and then incubated for 24 hrs in the presence of human brain lysate containing Tau, then fixed and imaged for Tau aggregation (FRET). (B) Pre-incubation of Tau antibodies with brain lysate inhibited seeding and aggregation of Tau for the benchmark antibody (Ab306), 1A1, and 1C7. Anti-RSV was used as a negative control.

The ability of chimeric IgG antibodies 1A1 and 1C7 to inhibit Tau seeding by human brain lysate was performed as described below. A brief overview of the experimental design is shown in FIG. 12A.

FRET sensor cells (Tau RD P301S FRET Biosensor, Catalog: CRL-3275™, obtained from ATCC®) were plated on poly-D-lysine (PDL)-coated 96-well plates (Corning® BioCoat™ Poly-D-Lysine Mutiwell Plates, Catalog: 356640, obtained from Thermo Fisher Scientific™) at a density of 30,000 per well in 100 μL per well DMEM (DMEM High Glucose (Catalog: 11-965-092) supplemented with 10% HI-FBS (Catalog: 10082-147), 1×MEM Non-Essential Amino Acids Solution (Catalog: 11-140-050), 1 mM Sodium Pyruvate (Catalog: 11-360-070), and 1× Penicillin-Streptomycin-Glutamine (Catalog: 10-378-016) (all obtained from Thermo Fisher Scientific™), and maintained at 37° C. with 5% $CO_2$ concentration. 4-5 hours after plating cells, protein seed containing hTau and anti-Tau antibodies were co-transfected using Lipofectamine® 2000. For each well, PBS-soluble fraction from Alzheimer's disease (AD) patient brain tissue or age-matched healthy control brain tissue (obtained from Banner Health® and prepared using the same protocol as described above as for ELISAs) containing 1 μg total protein (about 0.2 ng Tau protein), and anti-Tau or control anti-RSV antibody (2 μg) were diluted in 25 μL Opti-MEM™ (Catalog: 31-985-088, obtained from Thermo Fisher Scientific™) and incubated at 37° C. for 20 minutes. 25 μL Opti-MEM™ containing 0.5 μL Lipofecatmine® 2000 (Catalog: 11-668-019, obtained from Thermo Fisher Scientific™) was then added to the protein-antibody mixture and further incubated at room temperature for 10 minutes. DMEM of FRET sensor cells were then entirely replaced with the transfection mixture (50 μL Opti-MEM™ containing protein seed (1 μg total protein), antibodies (2 μg), and Lipofectamine® 2000 (0.5 μL) per well), and FRET sensor cells were kept at 37° C. with 5% $CO_2$ concentration for 24 hours. FRET sensor cells transfected with protein seeds with or without antibodies were then fixed in 1×PBS (Catalog: P0191, Teknova) containing 4% PFA (Catalog: 15714-S, Electron Microscopy Sciences) and 4% sucrose (Catalog: S5-3, obtained from Thermo Fisher Scientific™) for 15 minutes at room temperature, followed by 4× wash with 1×PBS.

For FRET quantification, fixed FRET sensor cells (typically about 10,000 cells per well) were imaged using an Opera Phenix High™ Content Screening System (obtained from PerkinElmer®) and images were quantified using the Harmony® software (obtained from PerkinElmer®). To acquire FRET images, a built-in CFP/YFP FRET acquisition protocol (excitation at 425 nm, donor emission at 435-480 nm, and acceptor emission at 500-550 nm) and a water-immersion 20× objective (NA=1.0) under the non-confocal mode was used. FRET intensity was defined as the ratio of acceptor fluorescence to donor fluorescence (FRET=acceptor/donor) per pixel. Mean FRET intensity was then calculated for each cell and a histogram showing the distribution of the mean FRET intensity (per cell) was generated for each condition (e.g., cells transfected with AD patient brain tissue lysate without antibody). The threshold to determine FRET positive cells was set around the highest mean FRET values of FRET sensor cells that were transfected with healthy control brain tissue lysate without antibodies (typical mean FRET intensity was greater than 2.5 or 2.6). The FRET signals of FRET-positive cells were integrated (iFRET: integrated FRET) and normalized by integrated FRET intensity of all the cells for each well.

Figure 12B:
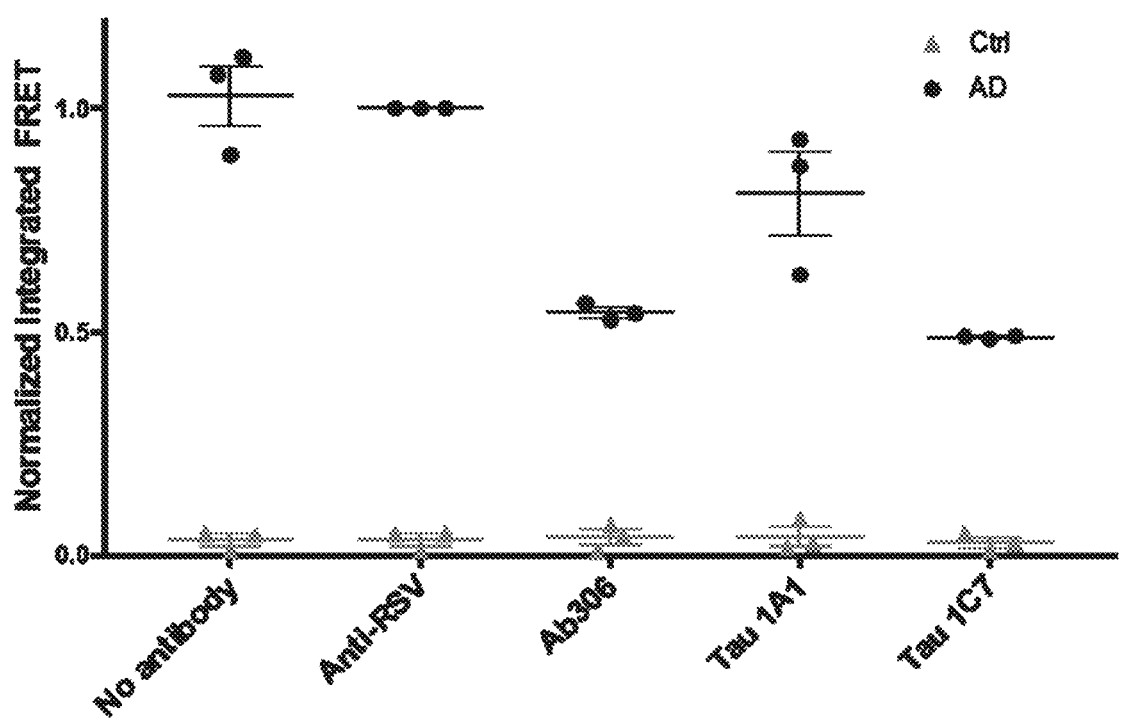

As shown in FIG. 12B, pre-incubation of anti-Tau antibody clones 1A1 and 1C7 with brain lysate inhibited the seeding and aggregation of Tau.

Pharmacokinetic Studies

Wild-type 6-8 week old male C57Bl6 mice (n=3/group) were intravenously dosed with 10 mg/kg of antibody (1A1 or 1C7). In-life bleeds were taken at 30 min, 1 day, 4 days, and 7 days post-dose via submandibular bleeds. Blood was collected in EDTA plasma tubes and spun at 14,000 rpm for 5 min. Plasma was then isolated for subsequent pharmacokinetic analysis.

Figure 13:
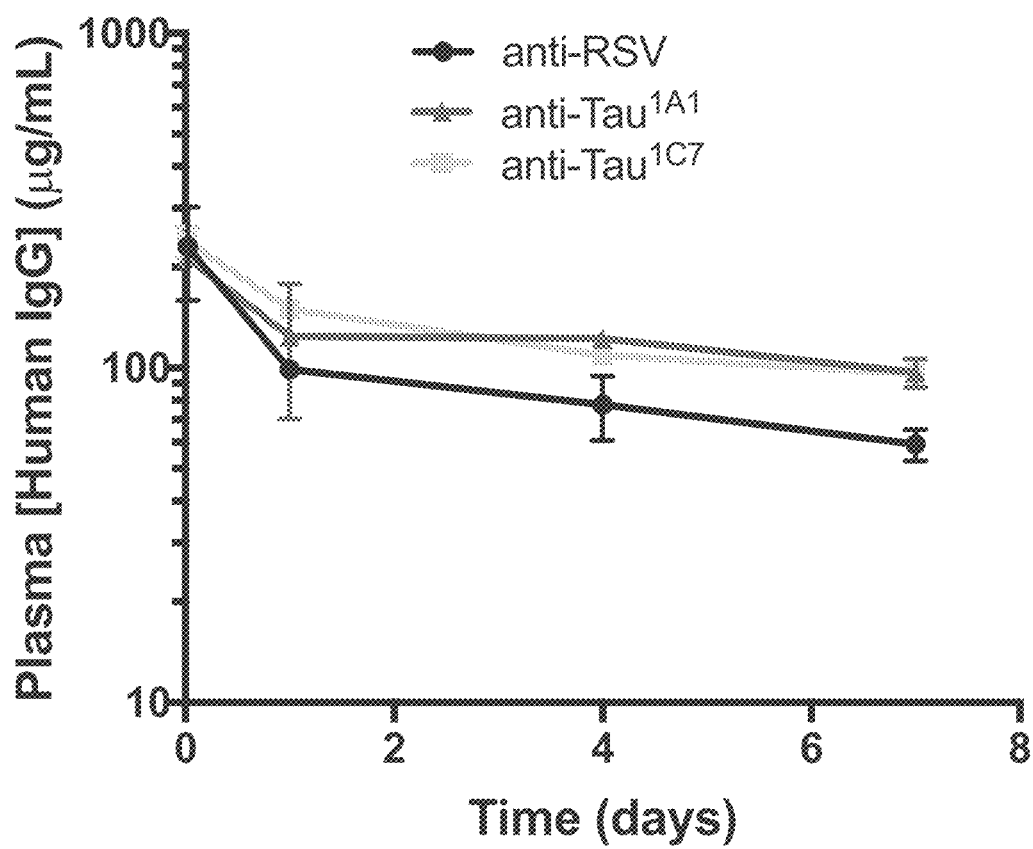
FIG. 13. In vivo pharmacokinetic analysis for chimeric IgG clones 1A1 and 1C7.

Antibody concentrations were quantified using a generic human IgG assay (MSD human IgG kit #K150JLD-4) following the manufacturer's protocol. Briefly, plates were blocked for 30 min with MSD Blocker A and diluted plasma samples (1:2500) were added in duplicate to the blocked plates using a Hamilton Nimbus liquid handler. Dosing solutions were also analyzed on the same plate to confirm the correct dosage. The standard curve, 0.78-200 ng/mL IgG, was fit using a four-parameter logistic regression. As shown in FIG. 13 and in Table 5 below, 1A1 and 1C7 exhibited in vivo pharmacokinetic properties within the expected range for an IgG and did not show any off-target clearance.

TABLE 5

| Antibody | Dose (mg/kg) | Mouse | CL (mL/day/kg) | $t_{1/2}$ (days) |
|---|---|---|---|---|
| anti-RSV | 10 | WT | 7.62 | 8.06 |
| anti-Tau$^{1A1}$ | 10 | WT | 3.13 | 16.7 |
| anti-Tau$^{1C7}$ | 10 | WT | 4.59 | 9.33 |

Figure 26A:
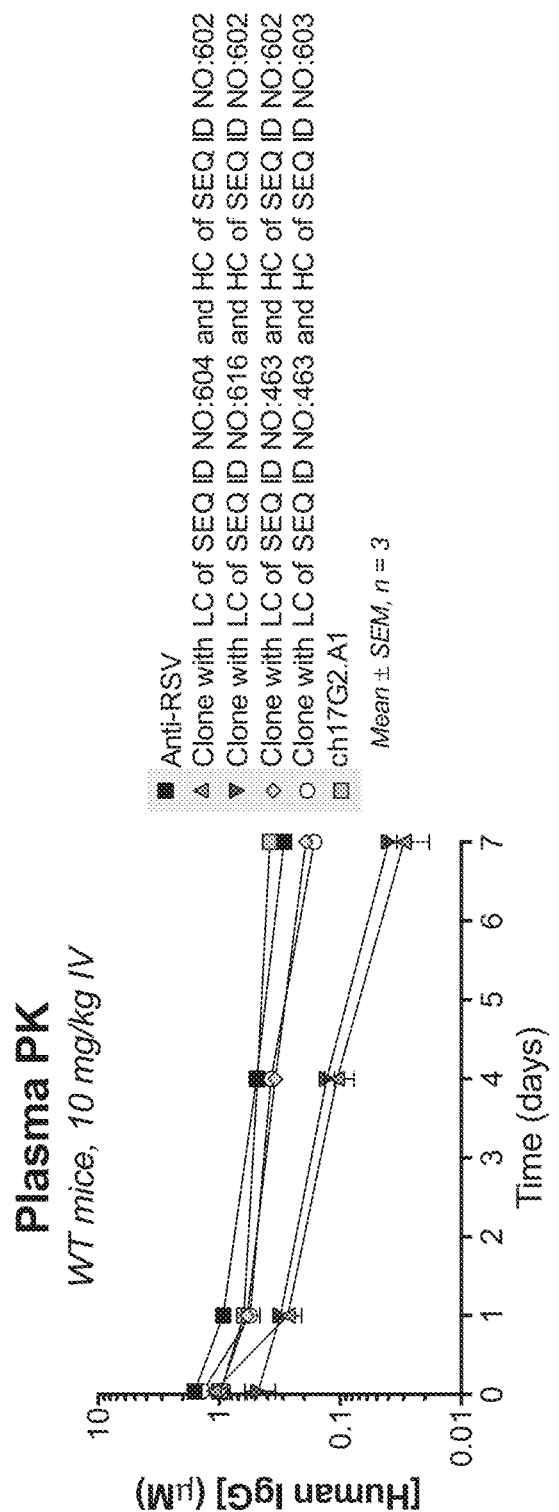

Further, plasma pharmacokinetic properties of additional anti-Tau clones were also measured following the same experimental protocol as described above, except that in-life bleeds were taken at 1 hour, 1 day, 4 days, and 7 days (Table 6 and FIGS. 26A and 26B).

TABLE 6

| Antibody | Isotype | Dose (mg/kg) | Time point (hr) | n/grp | Age | Sex |
|---|---|---|---|---|---|---|
| anti-RSV | hIgG1 LALAPG | 10 | 1 h, 1 d, 4 d, 7 d | 3 | 14 w | F |
| Clone with light chain of SEQ ID NO: 604 and heavy chain of SEQ ID NO: 602 | hIgG1 | 10 | 1 h, 1 d, 4 d, 7 d | 3 | 14 w | F |
| Clone with light chain of SEQ ID NO: 616 and heavy chain of SEQ ID NO: 602 | hIgG1 | 10 | 1 h, 1 d, 4 d, 7 d | 3 | 14 w | F |
| Clone with light chain of SEQ ID NO: 463 and heavy chain of SEQ ID NO: 602 | hIgG1 | 10 | 1 h, 1 d, 4 d, 7 d | 3 | 14 w | F |
| Clone with light chain of SEQ ID NO: 463 and heavy chain of SEQ ID NO: 603 | hIgG1 | 10 | 1 h, 1 d, 4 d, 7 d | 3 | 14 w | F |
| ch17G2.A1 | hIgG1 | 10 | 1 h, 1 d, 4 d, 7 d | 3 | 14 w | F |

Example 3. Refined Epitope Mapping of Chimeric IgG Antibody 1C7

This example describes refined epitope mapping of antibody 1C7 that reveals residues L114 and E115 as key residues in the epitope.

Refined Epitope Mapping

Full-length wild-type Tau and variants with single alanine mutations were genetically fused to the C-terminal truncated phage coat protein P3 and displayed on phage particles. To perform phage ELISA, 60 μL of 1 μg/mL anti-Tau antibodies in PBS was coated on maxi-sorp 96-well plate at 4° C. overnight. Next day, the plate was washed with PBST and blocked with ELISA buffer (PBS with 0.5% BSA) at room temperature for 1 hour. Freshly prepared phage particles were diluted in ELISA buffer and incubated on plate for 1 hour at room temperature. The plate was washed and then HRP conjugated anti-M13 Monoclonal Conjugate (GE 27942101) was added for another hour at room temperature. After extensive washing, the plate was developed with 60 μL/well of TMB one component substrate and the development was stopped with 60 μL/well of the 650 nm stop solution when the color is sufficiently developed (typically 1-5 minutes). Percentage of binding to each truncated Tau form was calculated as the ratio of binding signal to the signal from full-length Tau.

Figure 14A:
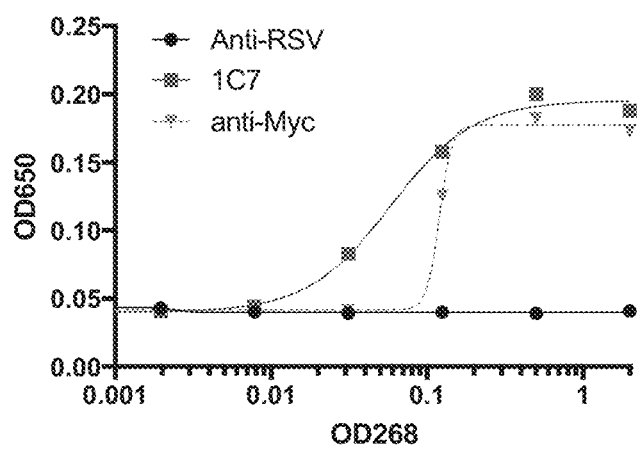
FIGS. 14A and 14B. ELISAs of chimeric anti-Tau antibody 1C7 analyzing binding of the antibody to variants of full-length wild-type Tau with a single alanine mutations.
Figure 14A:
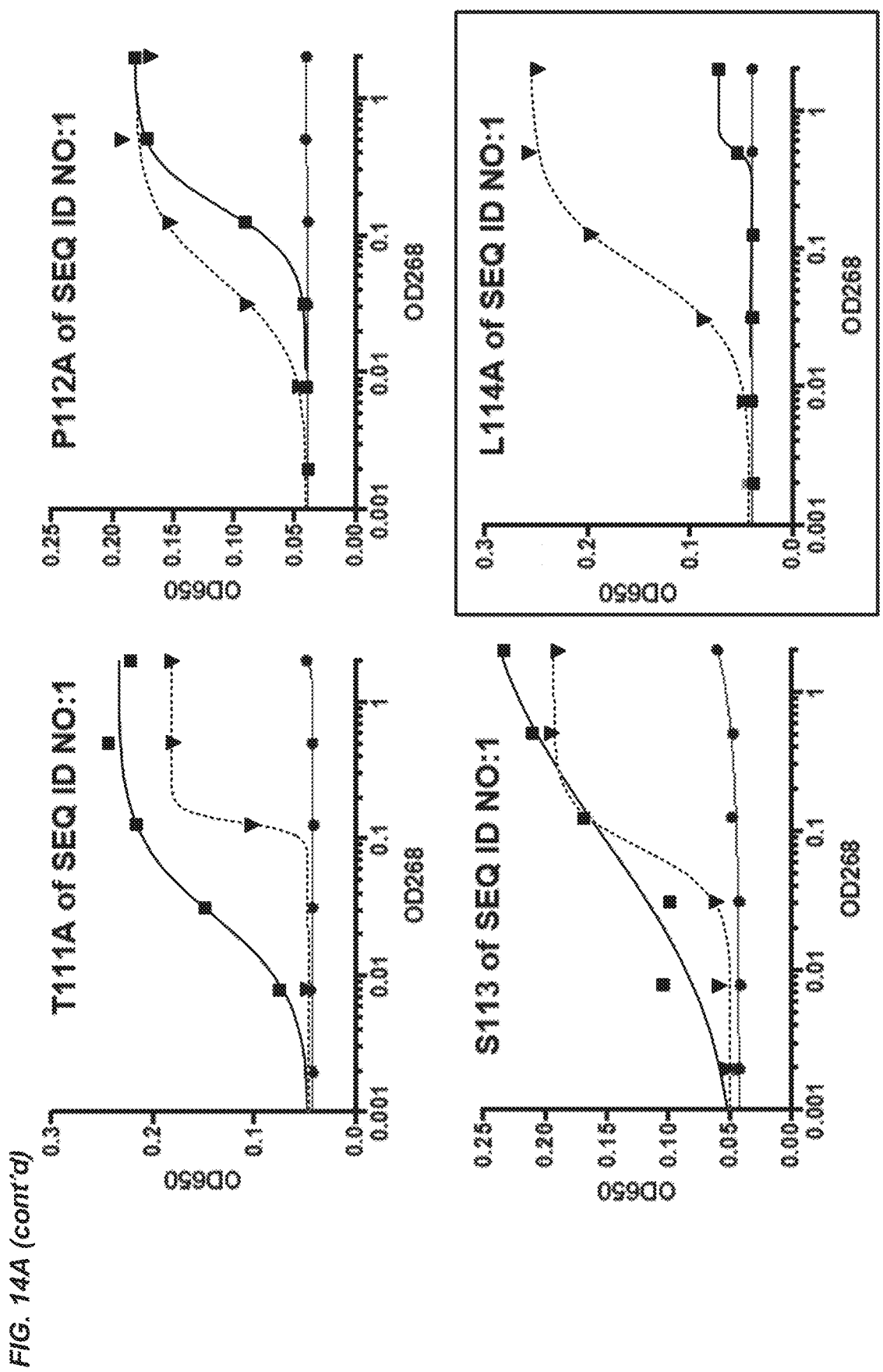
Figure 14A:
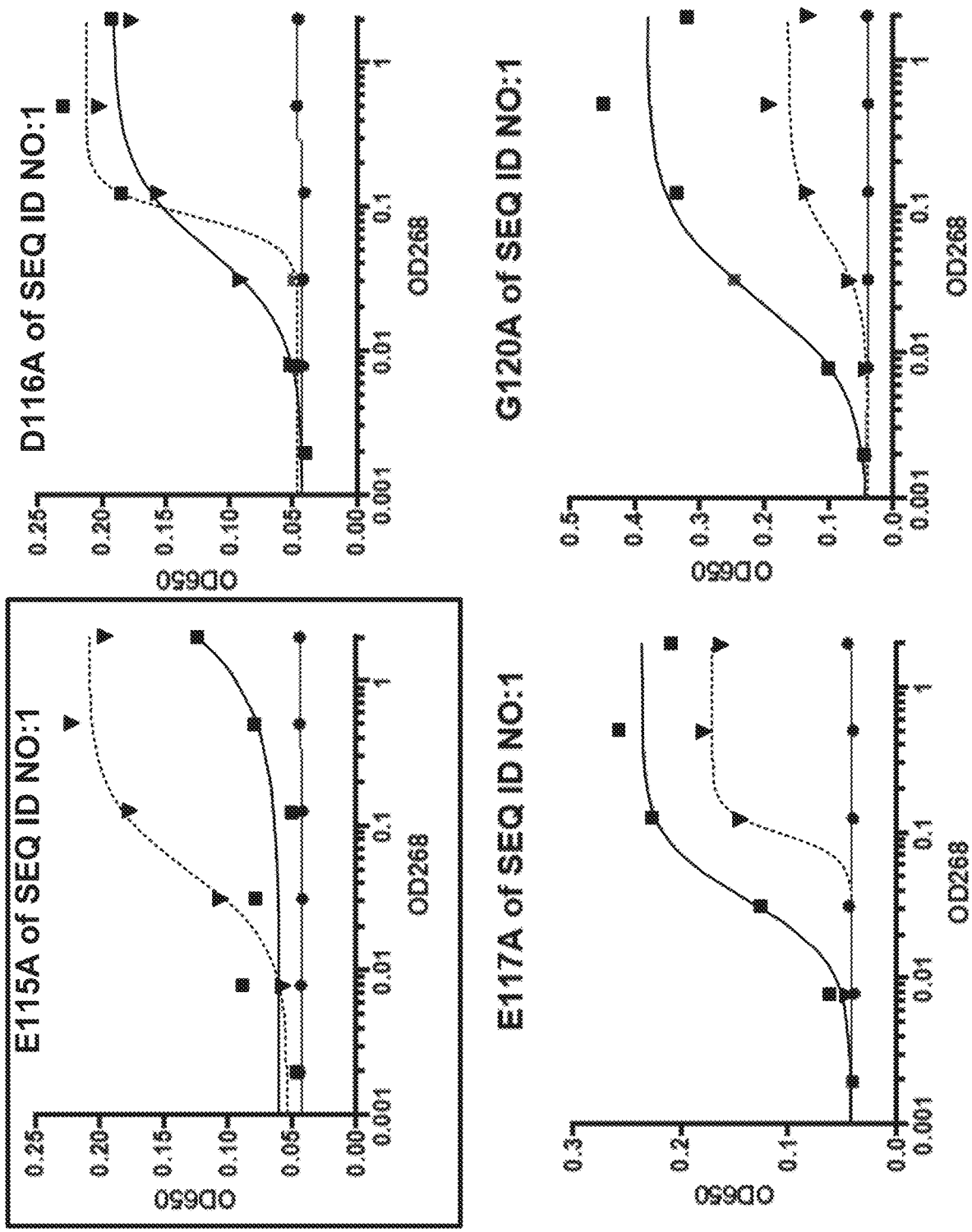
Figure 14B:
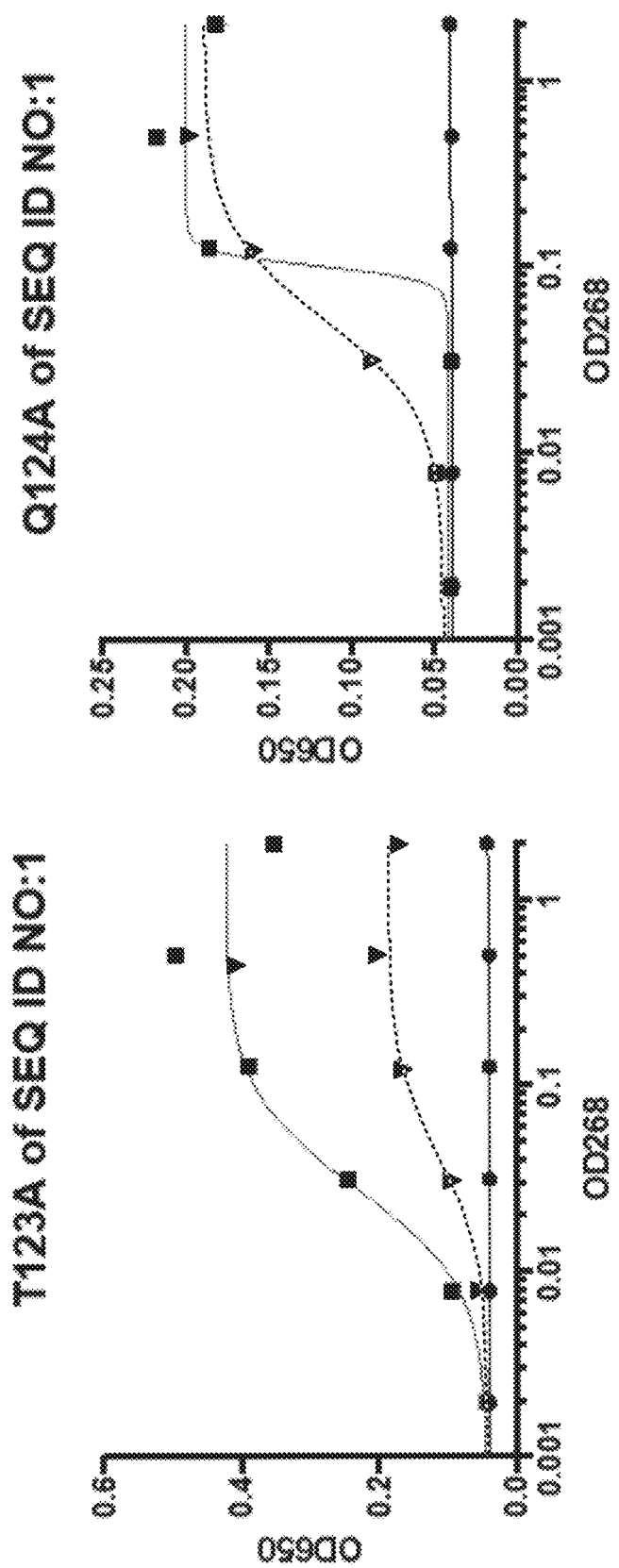

The results of the refined epitope mapping are shown in FIGS. 14A and 14B. Alanine mutations at L114 and E115 of the full-length wild-type Tau (SEQ ID NO:1) abolished binding of antibody 1C7 to the respective mutated Tau (boxed graphs in FIG. 14A). L114A and E115A mutations did not affect protein expression as indicated by the myc tag binding.

Example 4. In Vivo Dosing Studies of Chimeric IgG Clones 1C7 and 1A1 in Mice

This example describes antibody dosing studies in mice.
Immunization of Mice

Mice overexpressing human Tau from PS19 line were used to evaluate target engagement of chimeric IgG clones 1C7 and 1A1. This transgenic model harbors the T34 isoform of microtubule-associated protein Tau with one N-terminal insert and four microtubule binding repeats (1N4R) encoding the human P301S mutation, all driven by the mouse prion protein promoter. Female or male hemizygous mice (2-4-month-old) were obtained from Jackson Laboratory. They were injected i.v. (at 35 mg/kg) or i.p. (at 50 mg/kg) with a control IgG, chimeric IgG clone 1C7, or chimeric IgG clone 1A1. In-life blood was collected through the submandibular vein. At 2 or 7 days post-injection, mice were deeply anesthetized with Avertin and blood was collected via intracardiac puncture and processed to separate plasma by centrifugation at 13,000 RPM for 10 minutes. In addition, cerebral spinal fluid (CSF) was collected via the cisterna magna and visually inspected for potential blood contamination. Following transcardial perfusion with ice-cold PBS, brain tissue was removed and snap frozen.
Preparation of Brain (e.g., Hippocampus) Fractions A soluble protein extract from the brain tissue was prepared following a previously published method with slight modification. Briefly, brain tissue (or sub-dissected hippocampus) was weighed and homogenized in 9 volumes of high-salt buffer (Reassembly (RAB) buffer supplemented with protease and phosphatase inhibitors) using the Qiagen TissueLyser. Homogenized lysates were spun at 100,000×g for 30 minutes, and the supernatant was saved as the "soluble fraction". Pellets were further homogenized in RIPA buffer for analysis of detergent soluble fractions. Total protein content was measured using BCA assay (Pierce).
ELISA Measurements of Antibodies Bound to Tau
Total Tau Total human Tau from PS19 mouse brain, plasma, and CSF was measured using a commercial MSD kit for human Tau as per manufacturer's protocol, or an in-house developed ELISA using mouse monoclonal antibody HT7 to capture Tau, and biotinylated BT2 antibody as the detection antibody. Briefly, 2 μg/mL of PBS diluted HT7 was coated on 384-well ELISA plates overnight at 4° C. Next day, plates were washed with TBS-T and 2 μg/mL brain lysate, diluted plasma, or diluted CSF was added to the plates and the plates were incubated overnight at 4° C. Next day, plates were washed and detection antibody biotinylated-BT2 was added at 0.5 µg/mL for 15 minutes. Streptavidin HRP was used at 1:10000-1:20000 for detection.

Bound Tau

Tau bound to therapeutic chimeric IgG clones 1C7 and 1A1 was measured using a modified version of the protocol above. Briefly, plates were coated and samples were added as described above. After sample incubation, plates were washed and anti-human HRP was added at 1:5000 to detect antibody-bound Tau. A positive signal would be possible by the presence of human IgG bound to Tau in the brain lysate, plasma, or CSF.

Free Tau

Free Tau was measured using a modified version of the total Tau assay described above. Briefly, plates were coated and samples were added as described above. For measuring free Tau, a biotinyated version of the therapeutic antibody was generated and used as the detection antibody. Since the binding site of the biotinylated antibody is the same as the therapeutic antibody, only free Tau will give a positive signal since the binding site of Tau bound to therapeutic antibody would already be occluded. Streptavidin HRP was used as the secondary antibody. Standard curves for each antibody pair were generated to interpolate Tau values. All values are reported in nM and brain Tau is normalized to total brain protein.

Figures 15A, 15B:
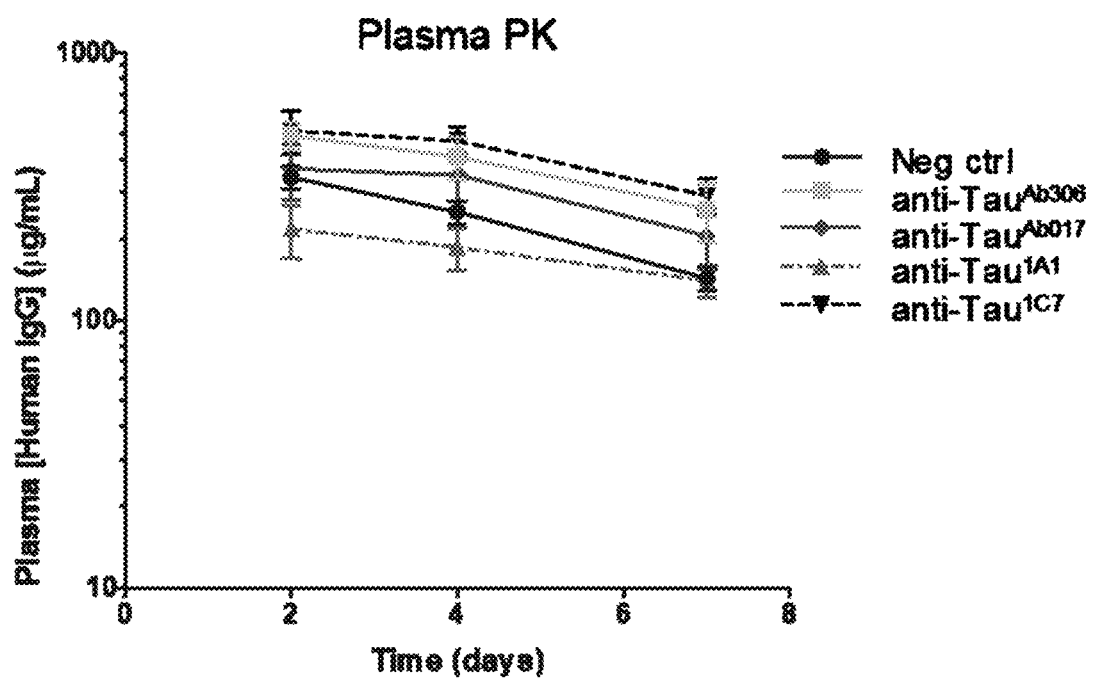
FIG. 15A. An outline of the plasma 7-day target engagement study of chimeric IgG clones 1C7 and 1A1 in PS19 Tau transgenic mice.
FIG. 15B. Chimeric IgG clones 1A1 and 1C7 both have expected PK in plasma compared to negative control or benchmark anti-Tau clones (Ab306 or Ab017).
Figure 15C:
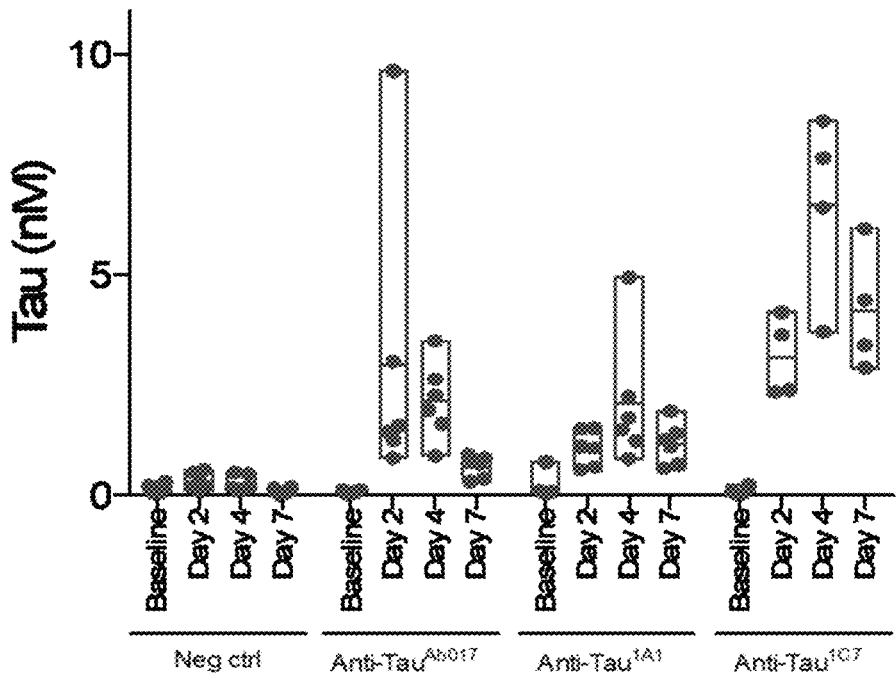
FIG. 15C. Plasma total Tau levels increased 2 days post-dose of anti-Tau antibody Ab017, chimeric IgG clone 1C7, or chimeric IgG clone 1A1 and remained high for at least 7 days post-dose.
Figure 15D:
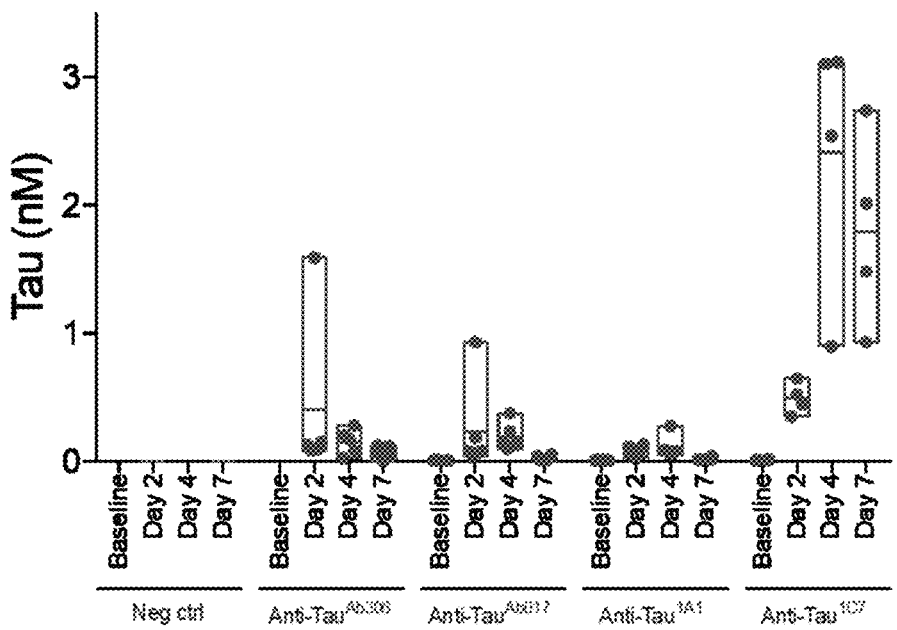
FIG. 15D. Plasma bound Tau levels also increased 2 days post-dose of anti-Tau antibody Ab017, chimeric IgG clone 1C7, or chimeric IgG clone 1A1. This effect was sustained well in the chimeric IgG clone 1C7 for at least 7 days post-dose.

FIGS. 15A-15D depict the results of 7-day target engagement study of chimeric IgG clones 1C7 and 1A1 in PS19 Tau transgenic mice. FIG. 15A outlines the plasma studies. After injection, plasma samples were collected at baseline, 2 days (2d), 4 days (4d), and 7 days (7d) post-dose. FIG. 15B illustrates that chimeric IgG clones 1C7 and 1A1 both have expected PK in plasma compared to negative control or benchmark anti-Tau clones (Ab306 or Ab017). FIG. 15C illustrates that plasma total Tau levels increased after 2 days and remained high for at least 7 days post-dose. FIG. 15D illustrates that plasma bound Tau levels also increased post-dose and this effect was sustained well in the 1C7 clone.

Figures 16A, 16B:
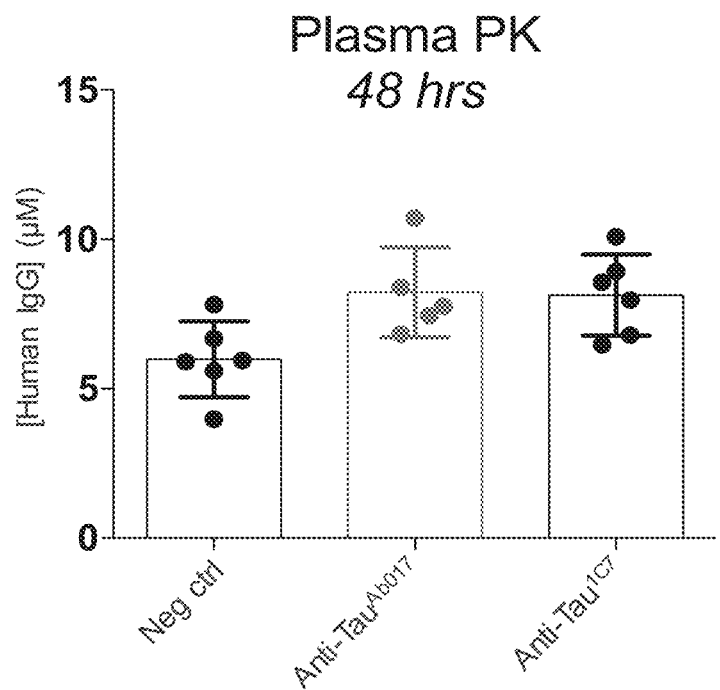
FIG. 16A. An outline of the plasma and brain 2-day target engagement study of chimeric IgG clone 1C7 in PS19 Tau transgenic mice.
FIGS. 16B-16D. Chimeric IgG clone 1C7 has expected PK in plasma and brain compared to negative control or benchmark anti-Tau antibody Ab017.
Figure 16C:
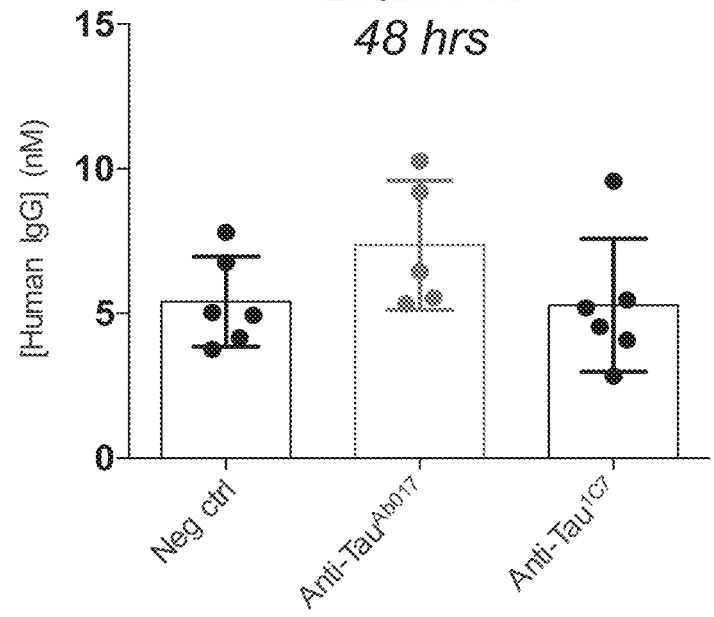
Figure 16D:
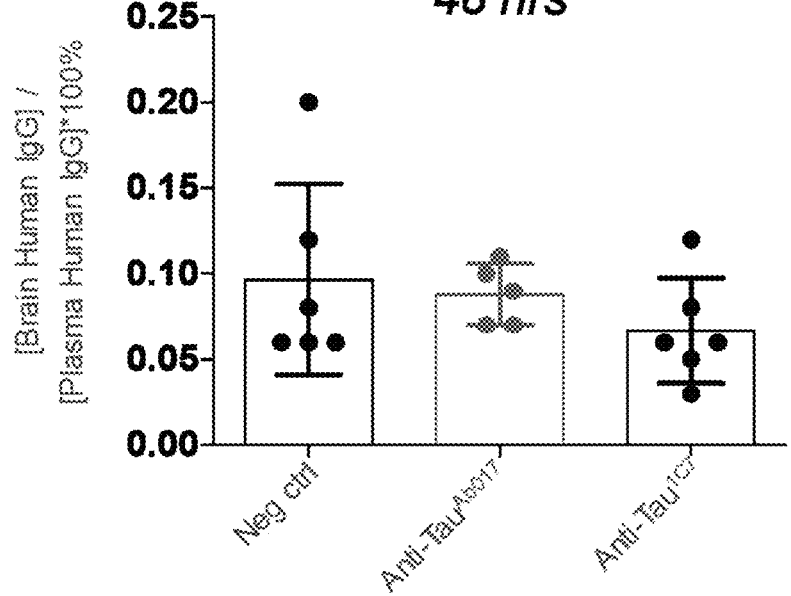
Figure 16E:
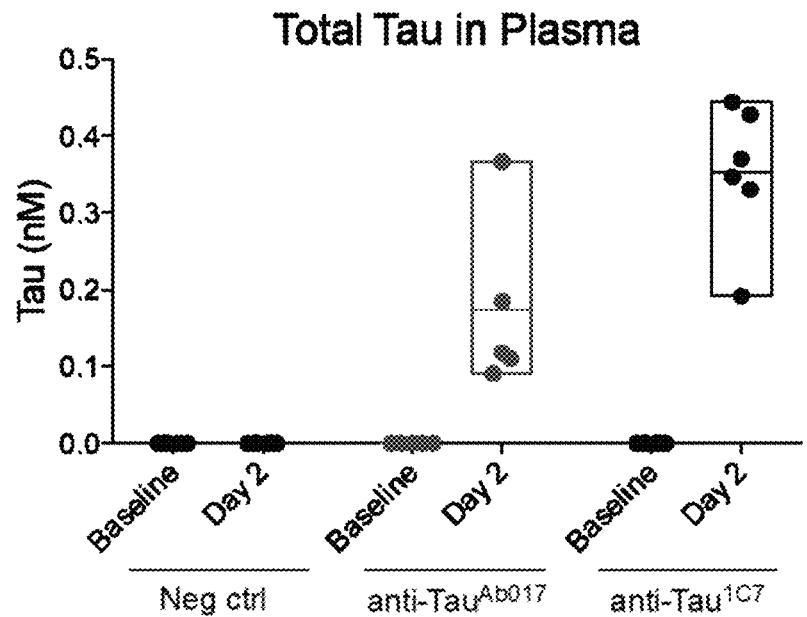
FIGS. 16E and 16F. Both chimeric IgG clone 1C7 and the benchmark anti-Tau antibody Ab017 significantly increased the plasma total (E) and bound (F) Tau levels at 2 days post-dose.
Figure 16F:
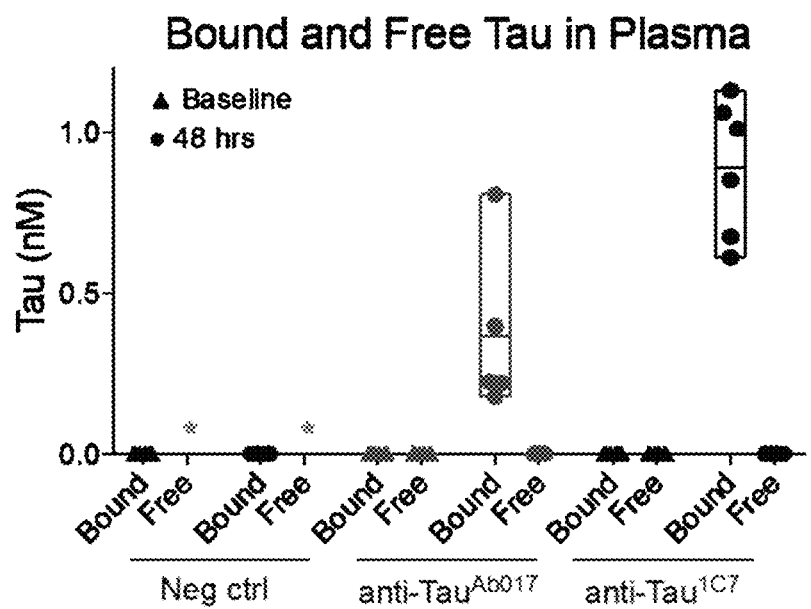
Figure 16G:
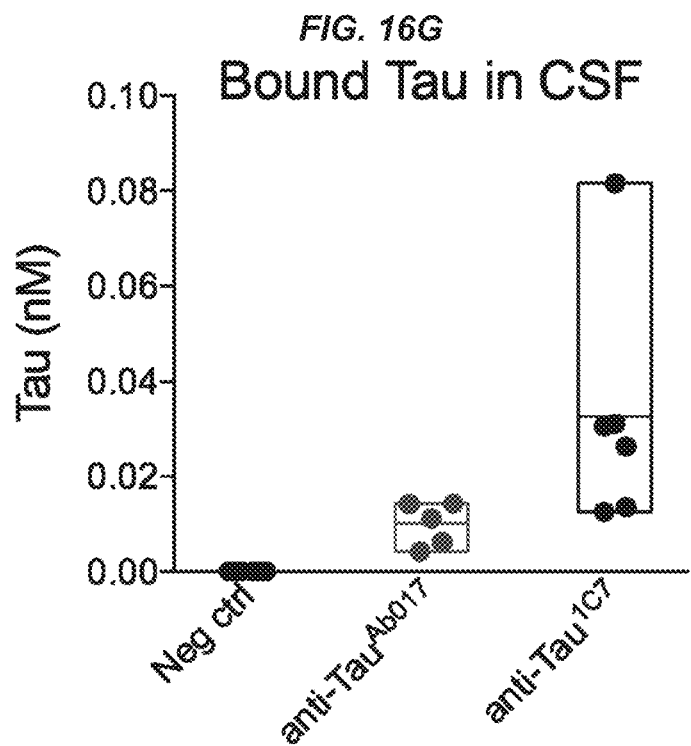
FIG. 16G. Chimeric IgG clone 1C7 also bound to Tau in the CNS as indicated by the observed increase in bound Tau in the CSF at 2 days post-dose.

FIGS. 16A-16G depict the results of 2-day target engagement study of chimeric IgG clone 1C7 in PS19 Tau transgenic mice. FIG. 16A outlines the plasma and brain studies. Plasma samples were collected at baseline and terminal CSF was collected at 2 days (2d) post-dose. FIGS. 16B-16D illustrates that chimeric IgG clone 1C7 has expected PK in plasma and brain compared to negative control or benchmark anti-Tau antibody Ab017. FIGS. 16E and 16F illustrate that both chimeric IgG clone 1C7 and the benchmark anti-Tau antibody Ab017 significantly increased the plasma total (FIG. 16E) and bound (FIG. 16F) Tau levels at 2 days post-dose. FIG. 16G illustrates that chimeric IgG clone 1C7 also bound to Tau in the CNS as indicated by the observed increase in bound Tau in the CSF at 2 days post-dose.

AD Patient Cerebral Spinal Fluid (CSF) Immunoprecipitation

Patient CSF was purchased from PrecisionMed. Protein A beads (SureBeads; Bio-Rad) were blocked in 2% BSA for 1 hour at 24° C. and then washed three times in TBST. Both Tween® 20 (0.02%) and EDTA-free complete protease inhibitors (Roche) were added to the CSF prior to incubation with antibodies. CSF (50 µL) was incubated for 1 hour at 4° C. with 2 µg of antibody. The CSF/antibody mixture was then added to 100 µL of blocked/washed beads and incubated for 18 hours at 4° C. The unbound fraction was collected and the beads were washed three times with 1 mL of wash buffer (50 mM Tris pH7, 100 mM NaCl, 0.5% TritonX-100) followed by one wash with 1 mL PBS. The bound fraction was then eluted by incubation with 45 µL elution buffer (Pierce) for 10 minutes and neutralized by addition of 5 µL Tris buffer (pH 8.8).

Figure 17:
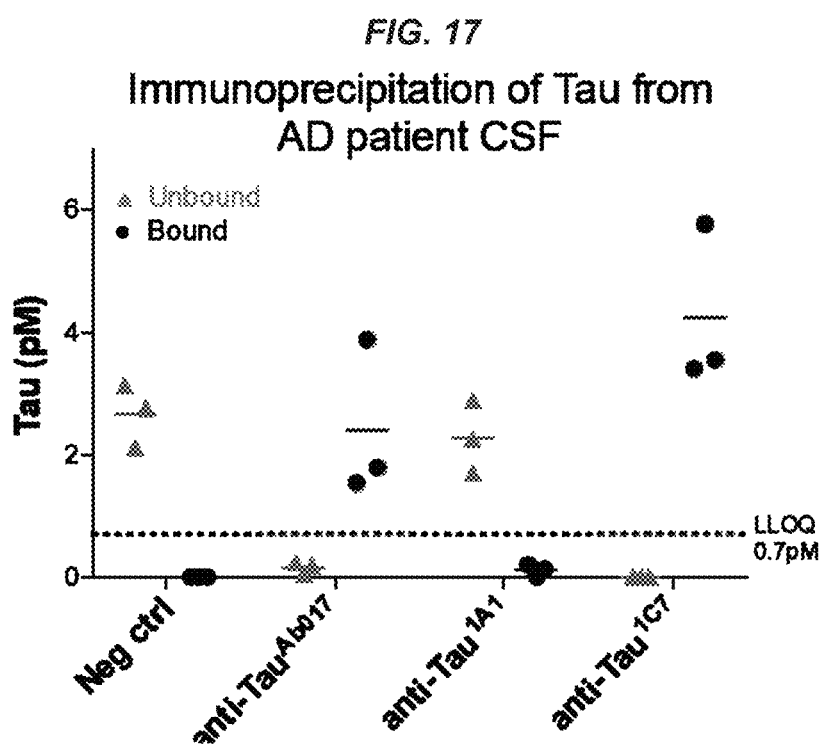
FIG. 17. Chimeric IgG clone 1C7 and the benchmark anti-Tau antibody Ab017 were able to pulldown Tau from Alzheimer's disease (AD) patient CSF, anti-Tau 1A1 was not, indicating the epitope for antibody 1A1 is either not present or inaccessible in CSF Tau.

As shown in FIG. 17, the unbound (▲) and bound (•) Tau was measured by ELISA and each dot represents a unique patient (n=3) and the line indicates the mean of these values. The dotted line represents the lower limit of quantification (LLOQ) of the ELISA assay. Though chimeric IgG clone 1C7 and the benchmark anti-Tau antibody Ab017 were able to pulldown Tau from Alzheimer's disease (AD) patient CSF, anti-Tau 1A1 was not, indicating the epitope for antibody 1A1 is either not present or inaccessible in CSF Tau.

Example 5. Humanized Murine Antibody and Affinity Matured Antibody Discovery and Screening of Murine Anti-Tau Antibody 1C7

This example illustrates the design, generation, and characterization of humanized and affinity matured antibodies of murine anti-Tau antibody 1C7.

Materials and Methods

Residue numbers are according to Kabat (Kabat et al., *Sequences of Proteins of Immunological Interest*, 5th Ed., Public Health Service, National Institutes of Health, Bethesda, Md. (1991)).

Direct Hypervariable Region Grafts onto the Acceptor Human Consensus Framework

Variants constructed during the humanization of murine anti-Tau antibody 1C7 (mu1C7) were assessed in the form of an IgG. The VL and VH regions from mu1C7 were aligned with the human VL kappa IV ($VL_{KIV}$) and human VH subgroup III ($VH_{III}$) consensus sequences. Hypervariable regions (HVR) from the mu1C7 were engineered into $VL_{KIV}$ and $VH_{III}$ acceptor frameworks to generate CDR-graft variants. From the mu1C7 VL region, positions 24-34 (L1), 50-56 (L2), and 89-97 (L3) were grafted into $VL_{KIV}$. From the mu1C7 VH region, positions 26-35 (H1), 50-65 (H2), and 93-102 (H3) were grafted into $VH_{III}$ (FIG. 3). The HVR definitions are defined by their sequence hypervariability (Wu and Kabat, *J. Exp. Med.* 132:211-250, 1970), their structural location (Chothia and Lesk, *J. Mol. Biol.* 196:901-917, 1987), and their involvement in antigen-antibody contacts (MacCallum et al., *J. Mol. Biol.* 262: 732-745, 1996). To evaluate framework Vernier positions that might be important, selected Vernier positions were mutated back to the murine sequence. The Vernier positions include S49 and S75 in VH. Four different versions of VH sequences were synthesized (gblocks from Integrated DNA Technologies (IDT)) and cloned into mammalian expression vectors. Four different humanized graft variants (v1, v2, v3, and v4) were generated and evaluated by surface plasmon resonance (SPR) analysis.

Affinity Maturation

The phagemid used for this work is a monovalent Fab-g3 display vector consisting of 2 open reading frames under control of a single Lac promoter. The first open reading frame consists of the OmpA signal sequence fused to the VL and CL domains of the acceptor light chain and the second open reading frame consists of the PelB signal sequence fused to the VH and CH1 domains of the acceptor heavy chain followed by the C-terminal truncated phage coat protein P3. The CDR-graft variant (hu1C7.v2) was generated as the Fab displayed on phage.

To improve affinity, a total of thirteen phage libraries containing changes in hypervariable regions were generated (see, Table 7). Sequence diversity was introduced at the selected randomization regions using Kunkel mutagenesis.

For NNK randomized libraries, positions in the hypervariable region were each fully randomized one at a time to all possible 20 amino acids using oligonucleotides encoding NNK. Oligos for positions located in the same hypervariable region were pooled and one library for each CDR loop was generated. For soft randomized libraries, positions in the hypervariable region were kept at 50% mutation rate by using oligonucleotides with a mixture containing 70% of the base found in the wild-type sequence and 10% each of the other three bases at each position. This allows multiple residues in the targeted region to be simultaneously randomized.

TABLE 7

| Libraries | Randomization regions |
|---|---|
| 1 | L1.NNK |
| 2 | L2.NNK |
| 3 | L3.NNK |
| 4 | H1.NNK |
| 5 | H2.NNK |
| 6 | H3.NNK |
| 7 | L1.soft |
| 8 | L2.soft |
| 9 | L3.soft |
| 10 | H1.soft |
| 11 | H2.soft |
| 12 | H3.soft |
| 13 | L3.soft_H3.soft |

Generation of Phage Libraries

Oligonucleotides designed to introduce diversity into each hypervariable region were phosphorylated separately in 20-4, reactions containing 660 ng of oligonucleotide, 50 mM Tris pH 7.5, 10 mM $MgCl_2$, 1 mM ATP, 20 mM DTT, and 5 U polynucleotide kinase for 1 hour at 37° C. From the phosphorylated oligonucleotide reactions, 2 µL was added to 500 ng Kunkel template in 50 mM Tris pH 7.5, 10 mM $MgCl_2$ in a final volume of 25 µL. The mixture was annealed at 90° C. for 1 minute, 50° C. for 3 minutes and then cooled on ice. The annealed template was then filled in by adding 0.5 µL 10 mM ATP, 0.5 µL 10 mM dNTPs (10 mM each of dATP, dCTP, dGTP, and dTTP), 1 µL 100 mM DTT, 1 µL 10×TM buffer (0.5 M Tris pH 7.5, 0.1 M $MgCl_2$), 80 U T4 ligase, and 4 U T7 polymerase in a total volume of 30 µL for 2 hours at room temperature. These filled-in and ligated products were then each transformed into XL1-blue cells. The libraries were recovered in 10 mL SOC media for 1 hour at 37° C. Carbenacillin (50 µg/mL) and M13/KO7 helper phage (MOI 10) were added. The cultures were incubated for another 30 minutes at 37° C., transferred to 500 mL 2YT containing 50 µg/mL carbenacillin and 50 µg/mL kanamycin, and grown overnight at 30° C.

Phage Selections

Recombinant Tau (r-Tau) was biotinylated through free amines using Sulfo-NHS-LC-Biotin (Thermo Scientific). For biotinylation reactions, a 3-fold molar excess of biotin reagent was used in PBS. Reactions were followed by extensive dialysis in PBS.

Phage was harvested from the cell culture supernatant and suspended in PBS containing 1% BSA. The phage libraries were incubated with biotinylated Tau at room temperature and the phage bound to biotin-r-Tau was then captured for 5 minutes on Dynabeads M-280 Streptavidin. The beads were washed extensively with PBS containing 0.05 Tween 20 (PBST) and the bound phage was eluted by incubating the wells with 100 mM Glycine (pH 2.7) for 15 minutes. Eluted phage was neutralized with 1.5 M Tris, pH 8.8, amplified using TG1 cells and M13/K07 helper phage, and grown overnight at 37° C. in 2YT, 50 µg/mL carbenacillin, and 50 µg/mL kanamycin. The titers of phage eluted from antigen immobilized beads were compared to titers of phage recovered from beads without antigen to assess enrichment. Selection stringency was increased by both decreasing concentration of biotin-r-Tau (from 10 nM to 0.1 nM) during binding and increasing the competition time (from 0 to 2 hours at room temperature) with 1 µM of unlabeled r-Tau in solution.

SPR Assessment of Variants

Humanized variants of murine anti-Tau antibody 1C7 (hu1C7 variants) were expressed as IgG by 293 transient transfection. IgG was purified with protein A affinity chromatography. The affinity of each hu1C7 IgG variant for r-Tau was determined by surface plasmon resonance using a Biacore™ T200 instrument. Biacore™ Series S CM5 sensor chips were immobilized with monoclonal mouse anti-human IgG (Fc) antibody (Human antibody capture kit from GE Healthcare). Serial 3-fold dilutions of each hu1C7 variant were injected at a flow rate of 30 µL/minute. Each sample was analyzed with 3-minute association and 10-minute dissociation. After each injection, the chip was regenerated using 3 M $MgCl_2$. Binding response was corrected by subtracting the RU from a flow cell capturing an irrelevant IgG at similar density. A 1:1 Languir model of simultaneous fitting of $k_{on}$ and $k_{off}$ was used for kinetics analysis.

Results and Discussion

Humanization of 1C7

The human acceptor framework used for humanization of murine anti-Tau antibody 1C7 is based on the human VL kappa IV consensus ($VL_{KIV}$) sequence and the human VHIII consensus ($VH_{III}$) sequence. The VL and VH regions of murine anti-Tau antibody 1C7 were aligned with the human $VL_{KIV}$ and $VH_{III}$ domains; hypervariable regions were identified and grafted into the human acceptor framework to generate hu1C7 variants (FIG. 3). The chimeric murine anti-Tau antibody 1C7 binds to r-Tau with a monovalent affinity of 0.8 nM. The humanized 1C7 variants showed about two-fold weaker binding to r-Tau with affinities around 1.6 nM (Table 8).

TABLE 8

Summary of binding kinetics of humanized 1C7 clones

| | $k_a$ (1/Ms) | $k_d$ (1/s) | $K_D$ (pM) |
|---|---|---|---|
| 1C7.IgG | 8.6E+05 | 7.3E−04 | 0.8 |
| hu1C7.v1 | 7.2E+05 | 1.3E−03 | 1.8 |
| hu1C7.v2 (S49A) | 7.6E+05 | 1.1E−03 | 1.5 |
| hu1C7.v3 (S75A) | 7.3E+05 | 1.2E−03 | 1.7 |
| hu1C7.v4 (S49A, S75A) | 6.6E+05 | 1.1E−03 | 1.8 |

Affinity Maturation

Affinity maturation libraries were explored in an effort to recruit further improvements using the framework of hu1C7.v2, which contains the Vernier position (S49A) in the heavy chain. Each hypervariable region was randomized using Kunkle mutagenesis (a total of 13 libraries, 6 NNK libraries and 7 soft randomized libraries; Table 7). The affinity maturation libraries were panned 4 rounds in solution with biotinylated r-Tau. Selection stringency was gradually increased by decreasing the concentration of biotin-r-Tau (from 10 to 0.1 nM) and increasing the competition time (from 0 to 2 hours at room temperature) with 1 µM of unlabeled r-Tau. Significant enrichments were observed for the L1, L3, H1, and H3 libraries.

Clones from the last round were picked for DNA sequence analysis. Sequence changes were identified in each CDR (Table 9A). The selected clones and additional combination variants were generated as IgGs by 293 transient transfection. Binding affinities were evaluated using Biacore™. Five to ten-fold off-rate improvements were observed for the affinity improved variants. All variants showed double to triple digit picomolar affinity to r-Tau (Table 10A).

TABLE 9A

Sequence alignments of CDR-H1, CDR-H3, CDR-L1, and CDR-L3 from the affinity matured variants

| | | | | | | | | | | |
|---|---|---|---|---|---|---|---|---|---|---|
| H1 (SEQ ID NO: 22) | G | F T F | S S Y G | M S | | | | | | |
| H1_1 (SEQ ID NO: 150) | G | F K F | S R V G | V S | | | | | | |
| H1_2 (SEQ ID NO: 151) | G | F T F | S R V G | T S | | | | | | |
| H1_3 (SEQ ID NO: 152) | G | F R F | S R V G | M S | | | | | | |
| H1_4 (SEQ ID NO: 153) | G | F R F | S G P G | M S | | | | | | |
| H1_5 (SEQ ID NO: 154) | V | I K W | R I Y G | M S | | | | | | |
| H3 (SEQ ID NO: 24) | A | R L P | Y | | | | | | | |
| H3_1 (SEQ ID NO: 155) | A | K L P | F | | | | | | | |
| L1 (SEQ ID NO: 26) | K | S S Q | S L L N | S G | N Q | K N | Y L | T | | |
| L1_1 (SEQ ID NO: 156) | K | S S H | S L Y S | S R | R H | K H | Y L | A | | |
| L1_2 (SEQ ID NO: 157) | K | S S Q | S L L R | S G | K R | Q N | Y L | V | | |
| L1_3 (SEQ ID NO: 158) | K | S S Q | S L H R | S G | T Q | K D | Y L | V | | |
| L3 (SEQ ID NO: 28) | Q | Q Y N | S Y P L | T | | | | | | |
| L3_1 (SEQ ID NO: 159) | Q | K Y N | S Y P L | T | | | | | | |
| L3_2 (SEQ ID NO: 160) | Q | K Y D | S Y P L | T | | | | | | |
| L3_3 (SEQ ID NO: 161) | Q | H Y R | T Y P L | T | | | | | | |
| L3_4 (SEQ ID NO: 162) | Q | H Y R | S Y P M | T | | | | | | |

TABLE 10A

Summary of binding kinetics of affinity matured clones based on hu1C7.v2

| | $k_a$ (1/Ms) | $k_d$ (1/s) | $K_D$ (pM) |
|---|---|---|---|
| hu1C7.v2 | 7.6E+05 | 1.1E−03 | 1500 |
| Clone with H1_1 | 2.07E+06 | 2.52E−04 | 122 |
| Clone with H1_2 | 1.56E+06 | 1.44E−04 | 92 |
| Clone with H1_4 | 1.32E+06 | 2.30E−04 | 174 |
| Clone with H1_5 | 1.34E+06 | 2.44E−04 | 183 |
| Clone with H3_1 | 1.97E+06 | 4.78E−04 | 242 |
| Clone with L1_1 | 1.54E+06 | 2.97E−04 | 192 |
| Clone with L1_3 | 2.15E+06 | 2.86E−04 | 133 |
| Clone with L1_3 and H1_4 | 2.28E+06 | 8.72E−05 | 38 |
| Clone with L1_3 and H1_1 | 1.64E+06 | 1.13E−04 | 69 |
| Clone with L1_3 and H3_1 | 2.36E+06 | 1.45E−04 | 62 |

A further round of affinity maturation was performed by mutating certain amino acids in selected CDR-H1, CDR-L1, and CDR-L3 sequences from Table 9A, as well as the sequence of CDR-H2 (SEQ ID NO:23) of hu1C7.v2. Sequence changes were identified in each CDR (Table 9B). Binding affinities were evaluated using Biacore™ (Table 10B).

TABLE 9B

Sequence alignments of CDR-H1, CDR-H2, CDR-L1, and CDR-L3 from the affinity matured variants

| | | | | | | | |
|---|---|---|---|---|---|---|---|
| H1_1 (SEQ ID NO: 150) | G | F K | F S | R V | G V | S |
| H1_1-1 (SEQ ID NO: 420) | G | F T | F S | R V | G V | S |
| H1_1-2 (SEQ ID NO: 421) | G | F K | F S | S V | G V | S |
| H1_1-3 (SEQ ID NO: 422) | G | F K | F S | Q V | G V | S |
| H1_1-4 (SEQ ID NO: 423) | G | F K | F S | M V | G V | S |
| H1_1-5 (SEQ ID NO: 424) | G | F K | F S | R Y | G V | S |
| H1_1-6 (SEQ ID NO: 425) | G | F K | F S | R V | G M | S |
| H1_2 (SEQ ID NO: 151) | G | F T | F S | R V | G T | S |

TABLE 9B-continued

Sequence alignments of CDR-H1, CDR-H2, CDR-L1,
and CDR-L3 from the affinity matured variants

| | | | | | | | | | |
|---|---|---|---|---|---|---|---|---|---|
| H1_2-1 (SEQ ID NO: 426) | G | F T | F S | S V | G T | S | | | |
| H1_2-2 (SEQ ID NO: 427) | G | F T | F S | M V | G T | S | | | |
| H1_2-3 (SEQ ID NO: 428) | G | F T | F S | Q V | G T | S | | | |
| H1_2-4 (SEQ ID NO: 429) | G | F T | F S | L V | G T | S | | | |
| H1_2-5 (SEQ ID NO: 430) | G | F T | F S | K V | G T | S | | | |
| H1_2-6 (SEQ ID NO: 431) | G | F T | F S | R Y | G T | S | | | |
| H1_2-7 (SEQ ID NO: 432) | G | F T | F S | R V | G M | S | | | |
| H1_4 (SEQ ID NO: 153) | G | F R | F S | G P | G M | S | | | |
| H1_4-1 (SEQ ID NO: 433) | G | F T | F S | G P | G M | S | | | |
| H1_4-2 (SEQ ID NO: 434) | G | F Q | F S | G P | G M | S | | | |
| H1_4-3 (SEQ ID NO: 435) | G | F M | F S | G P | G M | S | | | |
| H1_4-4 (SEQ ID NO: 436) | G | F R | F S | S P | G M | S | | | |
| H1_4-5 (SEQ ID NO: 437) | G | F R | F S | G Y | G M | S | | | |
| H1_HCv2 (SEQ ID NO: 586) | G | F T | F S | Q V | G M | S | | | |
| H1_HCv5 (SEQ ID NO: 587) | G | F K | F S | G P | G M | S | | | |
| H2 (SEQ ID NO: 23) | S | I S | G D | G G | S Y | I H | Y A | D S | V K |
| H2_1 (SEQ ID NO: 438) | S | I S | G E | G G | S Y | I H | Y A | D S | V K |
| H2_2 (SEQ ID NO: 439) | S | I S | G T | G G | S Y | I H | Y A | D S | V K |
| H2_3 (SEQ ID NO: 440) | S | I S | G S | G G | S Y | I H | Y A | D S | V K |
| H2_4 (SEQ ID NO: 441) | S | I S | G D | A G | S Y | I H | Y A | D S | V K |
| H2_5 (SEQ ID NO: 442) | S | I S | G D | G G | S Y | I H | Y A | S S | V K |
| H2_6 (SEQ ID NO: 443) | S | I S | G D | G G | S Y | I H | Y A | D A | V K |
| L1 (SEQ ID NO: 26) | K | S S | Q S | L L | N S | G N | Q K | N Y | L T |
| L1_4 (SEQ ID NO: 444) | K | S S | Q S | L L | Y S | G N | Q K | N Y | L T |
| L1_5 (SEQ ID NO: 445) | K | S S | Q S | L L | S S | G N | Q K | N Y | L T |
| L1_6 (SEQ ID NO: 446) | K | S S | Q S | L L | Q S | G N | Q K | N Y | L T |
| L1_7 (SEQ ID NO: 447) | K | S S | Q S | L L | N A | G N | Q K | N Y | L T |
| L1_3 (SEQ ID NO: 158) | K | S S | Q S | L H | R S | G T | Q K | D Y | L V |
| L1_3-1(SEQ ID NO: 448) | K | S S | Q S | L V | R S | G T | Q K | D Y | L V |
| L1_3-2(SEQ ID NO: 449) | K | S S | Q S | L L | R S | G T | Q K | D Y | L V |
| L1_3-3(SEQ ID NO: 450) | K | S S | Q S | L H | Y S | G T | Q K | D Y | L V |
| L1_3-4(SEQ ID NO: 451) | K | S S | Q S | L H | N S | G T | Q K | D Y | L V |
| L1_3-5(SEQ ID NO: 452) | K | S S | Q S | L H | M S | G T | Q K | D Y | L V |
| L1_3-6(SEQ ID NO: 453) | K | S S | Q S | L H | Q S | G T | Q K | D Y | L V |
| L1_3-7(SEQ ID NO: 454) | K | S S | Q S | L H | K S | G T | Q K | D Y | L V |
| L1_3-8(SEQ ID NO: 455) | K | S S | Q S | L H | L S | G T | Q K | D Y | L V |
| L1_3-9(SEQ ID NO: 456) | K | S S | Q S | L H | R S | G N | Q K | D Y | L V |
| L1_3-10(SEQ ID NO: 457) | K | S S | Q S | L H | R S | G T | Q K | N Y | L V |
| L1_3-11(SEQ ID NO: 458) | K | S S | Q S | L H | R S | G T | Q K | D Y | L A |

TABLE 9B-continued

Sequence alignments of CDR-H1, CDR-H2, CDR-L1, and CDR-L3 from the affinity matured variants

```
L1_3-12(SEQ ID NO: 459)   K  SS  QS  LL  YS  GN  QK  DY  LV

L3   (SEQ ID NO: 28)      Q  QY  NS  YP  LT

L3_5 (SEQ ID NO: 460)     Q  QY  YS  YP  LT

L3_6 (SEQ ID NO: 461)     Q  QY  SS  YP  LT

L3_7 (SEQ ID NO: 462)     Q  QY  NA  YP  LT
```

TABLE 10B

Summary of binding kinetics of further affinity matured clones based on hu1C7.v2

| | $k_a$ (1/Ms) | $k_d$ (1/s) | $K_D$ (nM) |
|---|---|---|---|
| hu1C7.v2 | 5.85E+05 | 8.51E-04 | 1454 |
| Clone with H1_2 | 2.76E+05 | 1.32E-04 | 478 |
| Clone with H1_2-1 | 1.41E+05 | 1.83E-04 | 1298 |
| Clone with H1_2-2 | 1.28E+05 | 9.71E-05 | 759 |
| Clone with H1_2-3 | 1.97E+05 | 9.39E-05 | 477 |
| Clone with H1_2-4 | 1.07E+05 | 1.51E-04 | 1411 |
| Clone with H1_2-5 | 2.49E+05 | 1.44E-04 | 578 |
| Clone with H1_2-6 | 7.55E+05 | 2.62E-04 | 347 |
| Clone with H1_4 | 5.64E+05 | 1.88E-04 | 333 |
| Clone with H1_4-1 | 1.72E+05 | 1.44E-04 | 837 |
| Clone with H1_4-2 | 3.08E+05 | 1.28E-04 | 416 |
| Clone with H1_4-3 | 4.04E+05 | 2.03E-04 | 502 |
| Clone with H1_4-4 | 3.31E+05 | 1.26E-03 | 3807 |
| Clone with H1_4-5 | 2.76E+05 | 1.63E-04 | 591 |
| Clone with H2_1 | 4.46E+05 | 3.69E-03 | 8277 |
| Clone with H2_2 | 4.15E+05 | 3.78E-03 | 9109 |
| Clone with H2_3 | 4.22E+05 | 4.08E-03 | 9681 |
| Clone with H2_4 | 4.84E+05 | 3.09E-03 | 6397 |
| Clone with H2_5 | 4.65E+05 | 1.76E-03 | 3788 |
| Clone with H2_6 | 4.62E+05 | 1.75E-03 | 3795 |
| Clone with L1_4 | 1.15E+06 | 6.62E-04 | 577 |
| Clone with L1_5 | 6.36E+05 | 8.85E-04 | 1391 |
| Clone with L1_6 | 1.17E+06 | 7.80E-04 | 665 |
| Clone with L1_7 | 1.10E+06 | 7.19E-04 | 651 |
| Clone with L1_3 | 1.22E+06 | 1.33E-04 | 109 |
| Clone with L1_3-1 | 1.01E+06 | 2.13E-04 | 211 |
| Clone with L1_3-2 | 1.10E+06 | 1.43E-04 | 130 |
| Clone with L1_3-3 | 2.72E+06 | 2.14E-04 | 78 |
| Clone with L1_3-4 | 1.50E+06 | 3.10E-04 | 206 |
| Clone with L1_3-5 | 1.05E+06 | 4.42E-04 | 419 |
| Clone with L1_3-6 | 1.09E+06 | 3.79E-04 | 349 |
| Clone with L1_3-7 | 1.12E+06 | 3.08E-04 | 275 |
| Clone with L1_3-8 | 7.67E+05 | 3.91E-04 | 510 |
| Clone with L1_3-9 | 1.13E+06 | 1.54E-04 | 136 |
| Clone with L1_3-10 | 9.37E+05 | 1.47E-04 | 157 |
| Clone with L1_3-11 | 9.65E+05 | 2.23E-04 | 231 |
| Clone with L3_5 | 8.48E+05 | 7.87E-04 | 928 |
| Clone with L3_6 | 8.26E+05 | 5.70E-04 | 690 |
| Clone with L3_7 | 6.85E+05 | 8.17E-04 | 1192 |
| Clone with L1_3, L3, and H1_HCv2 | 9.82E+05 | 1.16E-04 | 119 |
| Clone with L1_3, L3-6, and H1_HCv2 | 1.07E+05 | 1.80E-04 | 168 |
| Clone with L1_3-3, L3-6, and H1_HCv2 | 1.02E+05 | 1.80E-04 | 177 |
| Clone with L1_3-3, L3-6, and H1_HCv5 | 1.07E+05 | 1.64E-04 | 153 |

Example 6. Anti-Tau Hybridoma Antibody Discovery and Screening

This example illustrates the design, generation, and characterization of anti-Tau hybridoma antibodies that specifically bind to multiple Tau splice isoforms and that specifically bind to both phosphorylated human Tau and unphosphorylated human Tau. The antibodies also exhibit cross-species reactivity between human Tau and cynomolgus Tau.

Figure 18:
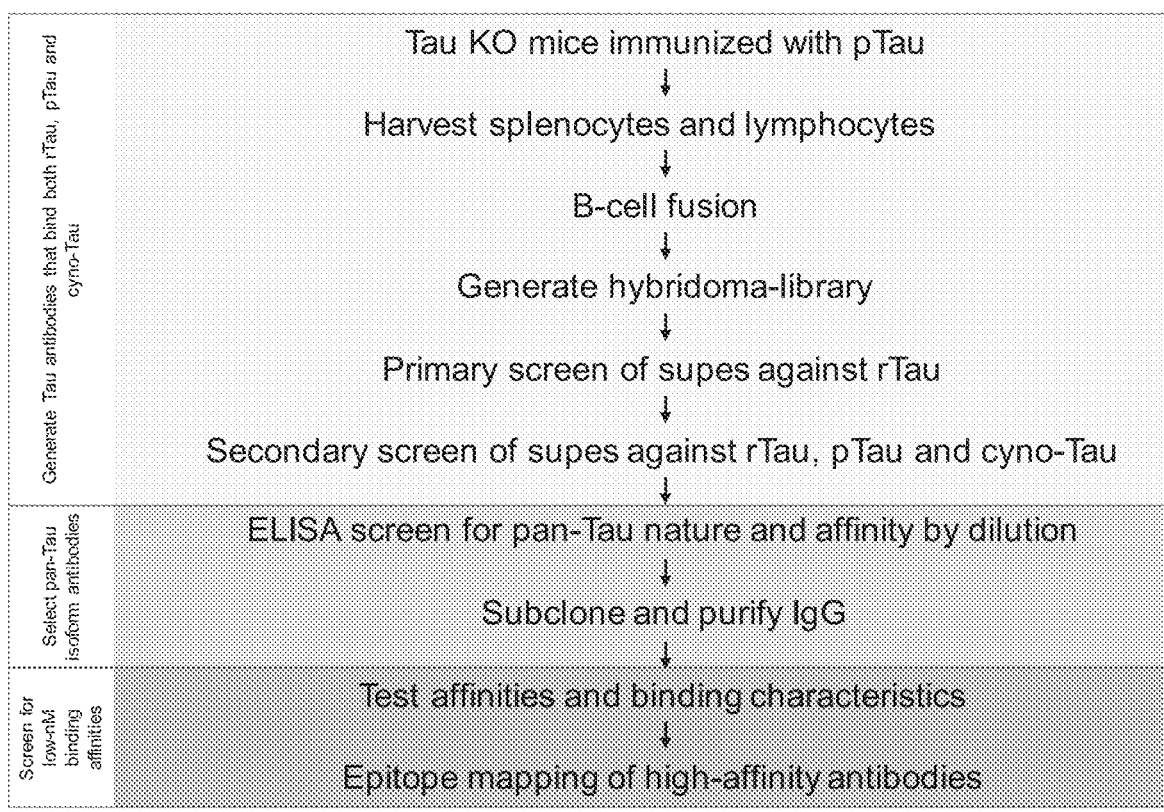
FIG. 18. Workflow of anti-Tau antibody discovery using a hybridoma technology.

A schematic for the hybridoma anti-Tau antibody discovery and screening program is shown in FIG. 18. As detailed below, mice were immunized with recombinant phosphorylated Tau (p-Tau), splenocytes and lympohocytes were harvested, and B-cells were processed and used to generate hybridoma library. Subsequently, anti-Tau antibodies that bound to r-Tau were selected in a primary screen. Positive hits from the primary screen were carried into a secondary screening where they were screened by ELISA for binding to r-Tau, p-Tau, and cyno-Tau. Further characterization of the hits on the five different Tau isoforms (Tau352 (0N3R), Tau383 (0N4R), Tau381 (1N3R), Tau410 (2N3R), and Tau441 (2N4R)), N-terminal truncated Tau (Tau (50-441)), and C-terminal truncated Tau (Tau (1-421)) was performed by the same method. The antibody clones were tested for binding affinity and binding characteristics and epitope mapping of high-affinity antibodies was performed.

Antigen Production
Recombinant Tau

Full-length (441 amino acid in length) recombinant Tau (r-Tau) was produced in *E. coli* BL21(DE3) cells. r-Tau was originally produced with a His6-Smt3 tag, which was used for affinity purification and subsequently cleaved and removed.

In Vitro r-Tau Phosphorylation

Recombinant Tau (r-Tau) was phosphorylated in vitro by incubation with 1:1 amounts of PKA and GSK3β in 50 mM MES, pH 6.8, 100 mM NaCl, 0.5 mM EGTA, 5 mM $MgCl_2$, and 1 mM ATP for 24 hours at room temperature. Phosphorylated r-Tau, p-Tau, was then purified to remove kinases and endotoxins.

Immunization of Mice

Tau knockout mice were immunized with recombinant hyperphosphorylated Tau (p-Tau). Immunizations were performed via Hock or footpad weekly with 5-10 μg of antigen in Ribi or Freund's adjuvant until serum antibody against r-Tau or p-Tau reacted in an ELISA to a dilution of greater than $10^5$, typically around six to eight weeks. Mice were given a final boost without adjuvent via intraperitoneal injection and sacrificed 3 days after the boost. Spleens and popliteal and inguinal lymph nodes were harvested, made into single cell suspensions by passing through cell strainers, and then the splenocytes and lymphocytes were used for hybridoma generation.

Generation of Hybridoma Library

B-cells harvested from lymph nodes were processed and counted. They were mixed with P3X63Ag8 cells 1:1 and fused using BTX Hybrimune Electrofusion apparatus. The fused hybridomas were plated in 50-96 well plates with 100 µL/well of HAT (Hypoxanthine-Aminopterin-Thymidine) selection media. The plates were fed with HT (Hypoxanthine Thymidine) after a week. After two weeks, 50 µL/well of supernatant was collected and screened for antigen specific binding.

Screening Antibodies for Binding to r-Tau, p-Tau, and Cyno-Tau

Primary screening was performed by coating 96-well ELISA Nunc plates overnight at 4° C. with 1 µg/mL r-Tau in PBS. The plates were washed three times with PBST using a Biotek plate washer. 50 µL/well of hybridoma supernatants were added to the plates with incubation at room temperature for 1 hour. Plates were washed three times with PBST. A secondary detection antibody goat X m HRP (Southern Biotech) at 1:2000 dilution, 50 µL/well was added to the plate and incubated for 1 hour at room temperature. At the end of an hour, plates were washed three time with PBST. Plates were developed with 50 µL/well of TMB substrate (Thermo Fisher) and quenched with 50 µL/well of 1N sulfuric acid. The signal was quantified on a BioTek® plate reader at A450. Wells with an OD three times the background for r-Tau were considered positive and carried forward for secondary screening.

Positives from primary screening were carried forward into the secondary screening where they were screened by ELISA using the above protocol on r-Tau, p-Tau, and cyno-Tau for binding and cross-reactivity. Further characterization on the five different Tau isoforms was performed by the same method.

Figure 19A:
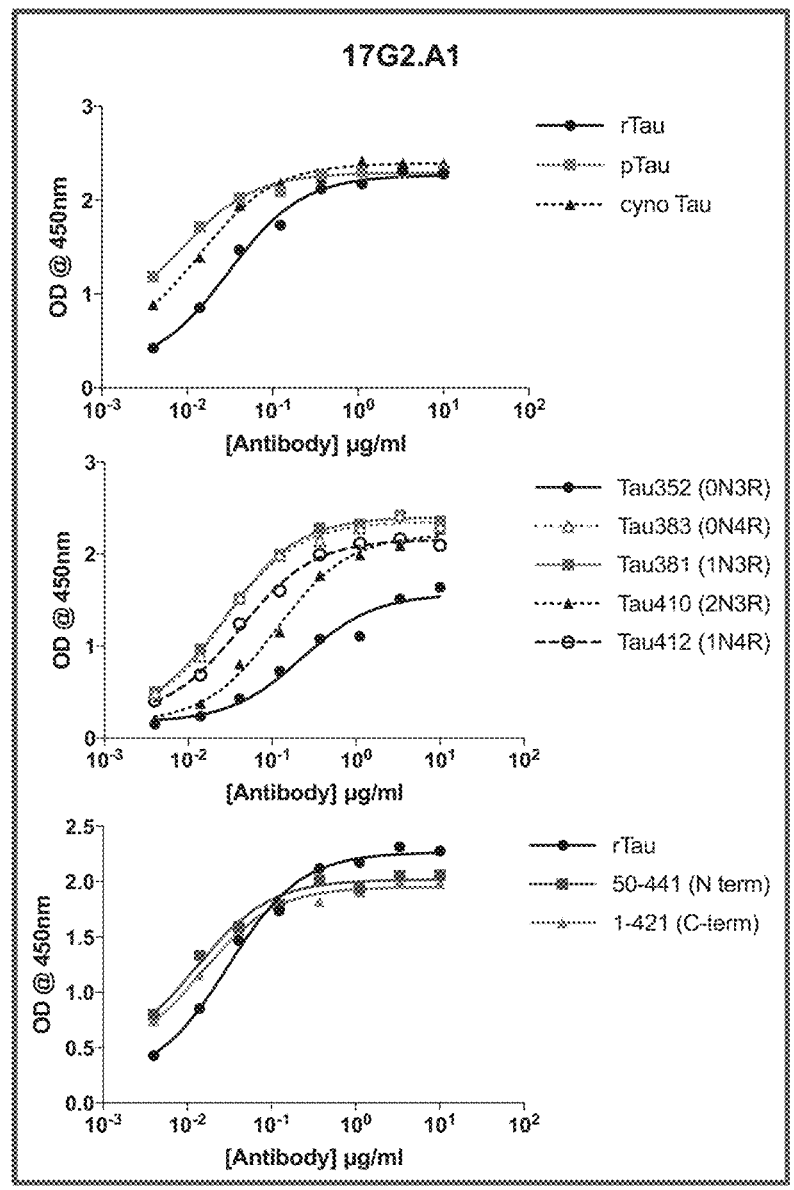
FIGS. 19A-19C. ELISAs of murine anti-Tau hybridoma antibodies 17G2.A1 (A), 19F7.C9 (B), and 24D2.B2 (C) analyzing binding of the antibodies to recombinant Tau441 (r-Tau), hyperphosphorylated Tau441 (p-Tau), cyno Tau441 (cyno-Tau), splice isoforms of human Tau (Tau352 (0N3R), Tau383 (0N4R), Tau381 (1N3R), Tau410 (2N3R), and Tau441 (2N4R)), N-terminal truncated Tau (Tau (50-441)), and C-terminal truncated Tau (Tau (1-421)).
Figure 19B:
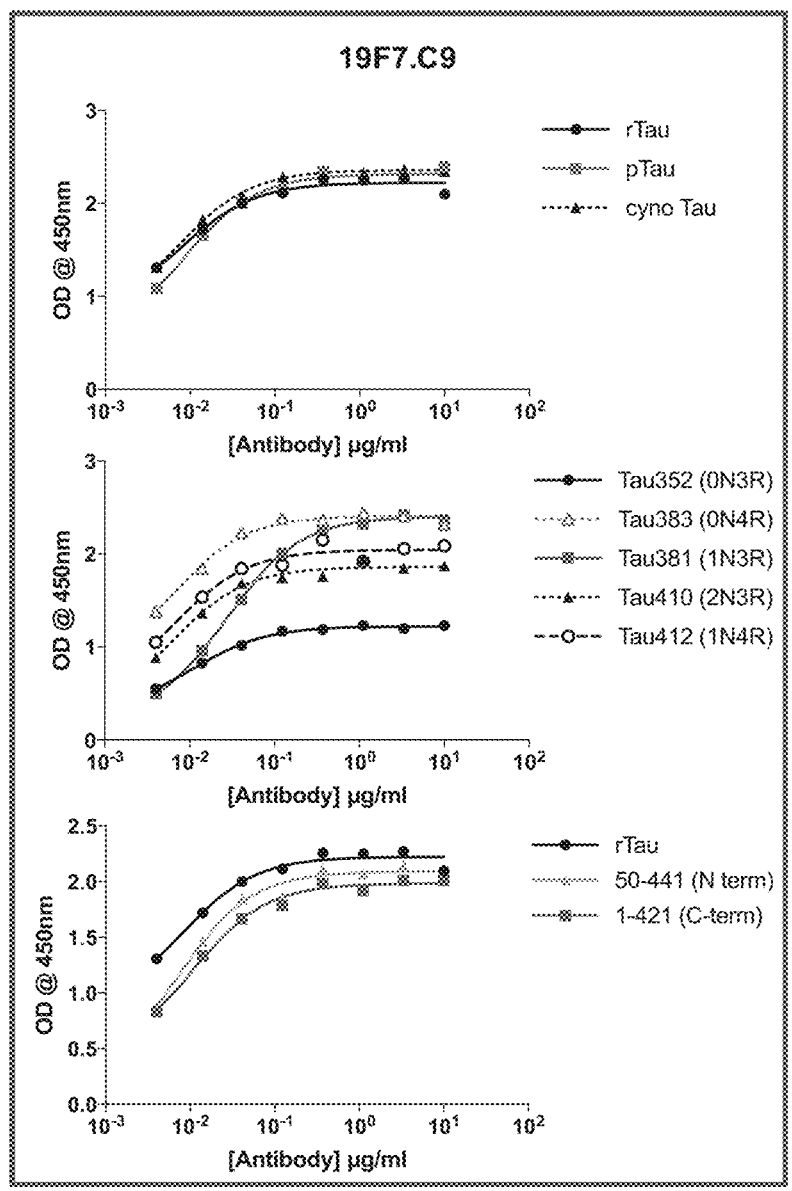
Figure 19C:
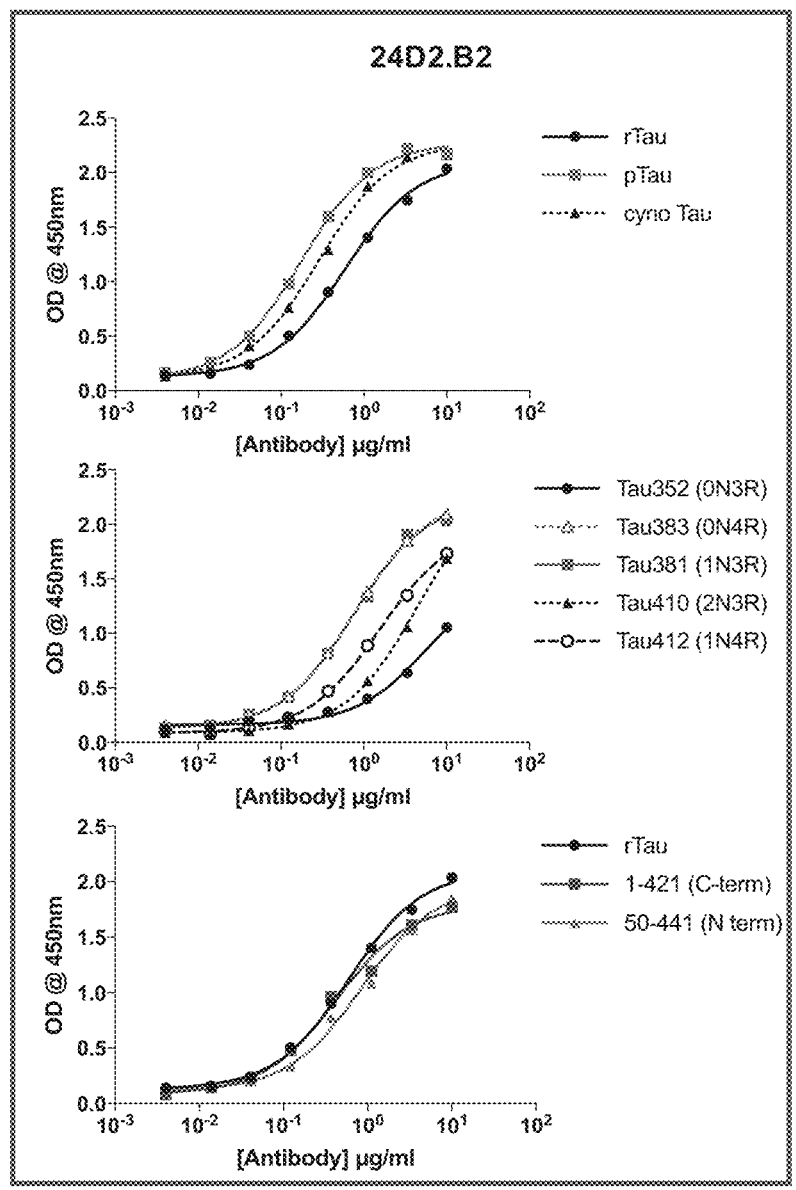

FIGS. 19A-19C depict the results of ELISAs in which clones 17G2.A1, 19F7.C9, and 24D2.B2 all bound to recombinant Tau441 (r-Tau), hyperphosphorylated Tau441 (p-Tau), cyno Tau441 (cyno-Tau), splice isoforms of human Tau (Tau352 (0N3R), Tau383 (0N4R), Tau381 (1N3R), Tau410 (2N3R), and Tau441 (2N4R)), N-terminal truncated Tau (Tau (50-441)), and C-terminal truncated Tau (Tau (1-421)). Clones 17G2.A1, 19F7.C9, and 24D2.B2 also all bound in the middle region of Tau (Tau (50-421); residues 50-421 of SEQ ID NO:1).

Biacore Assessment of the Selected Anti-Tau Antibodies

The affinity of each hybridoma antibody for r-Tau was determined by surface plasmon resonance using a Biacore™ T200 instrument. Biacore™ Series S CM5 sensor chips were immobilized with polyclonal rabbit anti-mouse IgG (Fc) antibody (mouse antibody capture kit from GE Healthcare). 1 µg/mL of antibody was captured for 1 minute on each flow cell and serial 3-fold dilutions of r-Tau were injected at a flow rate of 30 µL/min. Each sample was analyzed with a 3-minute association and a 10-minute dissociation. After each injection, the chip was regenerated using 10 mM Glycine-HCl (pH 1.7). Binding response was corrected by subtracting the RU from a flow cell capturing an irrelevant IgG at similar density. A 1:1 Languir model of simultaneous fitting of $k_{on}$, and $k_{off}$ was used for kinetics analysis.

Figure 20A:
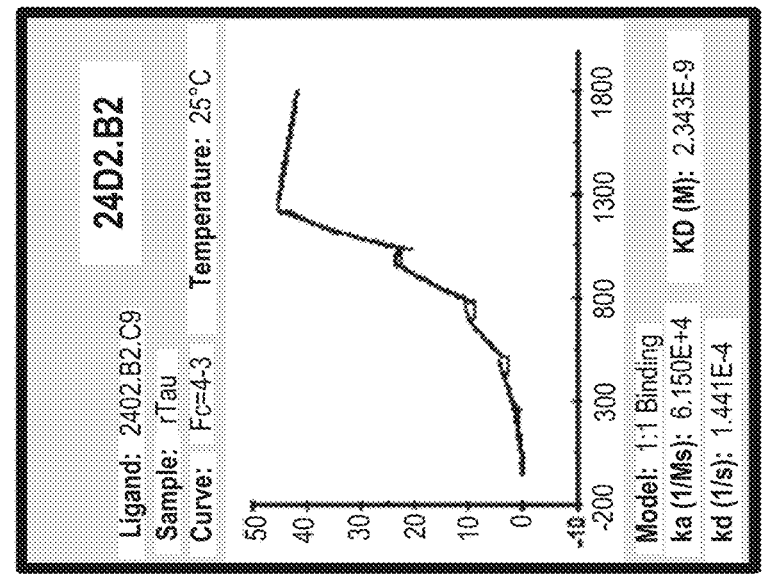
FIGS. 20A-20C. Biacore™ analysis of anti-Tau hybridoma antibodies binding to full-length human Tau (Tau441) for antibodies 17G2.A1 (A), 19F7.C9 (B), and 24D2.B2 (C).
Figure 20B:
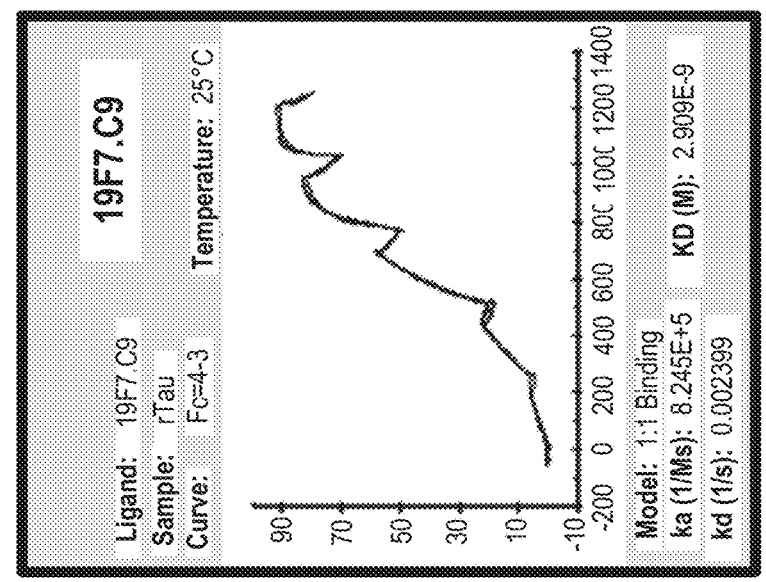
Figure 20C:
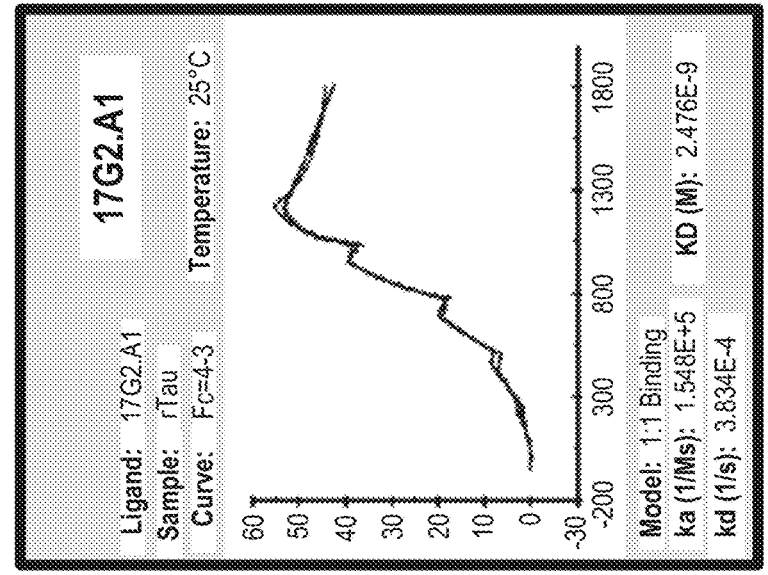

As shown in FIGS. 20A through 20C, clones 17G2.A1, 19F7.C9, and 24D2.B2 all exhibited fast on-rates and slow off-rates, consistent with strong binding affinity for r-Tau. Table 11 below further shows binding kinetics for clones 17G2.A1, 19F7.C9, and 24D2.B2 including their single digit nM binding affinity as measured by Biacore™, consistent with strong affinity for r-Tau.

TABLE 11

Binding kinetics of clones 17G2.A1, 19F7.C9, and 24D2.B2

| Ligand | $k_a$ (1/Ms) | $k_d$ (1/s) | $K_D$ (M) |
|---|---|---|---|
| 17G2.A1 | 1.55E+05 | 3.83E-04 | 2.48E-09 |
| 19F7.C9 | 8.25E+05 | 2.40E-03 | 2.91E-09 |
| 24D2.B2 | 6.15E+04 | 1.44E-04 | 2.34E-09 |

Epitope Mapping Using Phage-Display

Full-length Tau and truncated Tau were genetically fused to the C-terminal truncated phage coat protein P3 and displayed on phage particles. To perform phage ELISA, 60 µL of 1 µg/mL anti-Tau antibodies in PBS was coated on maxi-sorp 96-well plate at 4° C. overnight. Next day, the plate was washed with PBST and blocked with ELISA buffer (PBS with 0.5% BSA) at room temperature for 1 hour. Freshly prepared phage particles were diluted in ELISA buffer and incubated on plate for 1 hour at room temperature. The plate was washed and then HRP conjugated anti-M13 Monoclonal Conjugate (GE 27942101) was added for another hour at room temperature. After extensive washing, the plate was developed with 60 µL/well of TMB one component substrate and the development was stopped with 60 µL/well of the 650 nm stop solution when the color is sufficiently developed (typically 1-5 minutes). Percentage of binding to each truncated Tau was calculated as the ratio of binding signal to the signal from full-length Tau.

Epitope Mapping Using Peptide Microarrays

Full-length human Tau (encoded by the microtubule-associated protein Tau isoform 2 gene (MAPT), amino acid sequence NCBI Reference Sequence No. NP_005901.2, SEQ ID NO:1, variant designation "2N4R") was divided into 15 amino acid peptides, offset by 5 amino acids (overlapping by 10 amino acids). Peptides were synthesized and covalently attached to silica slides in triplicate with a spot size of 0.5 mm (obtained from JPT Technologies, Berlin, Germany). Antibodies muIgG were diluted to a concentration of 30 µg/mL in 3% bovine serum albumin in Tris-buffered saline (10 mM Tris, pH 7.5, 150 mM NaCl) supplemented with 0.05% Tween® 20 (3% BSA-TBST). Diluted antibodies were allowed to bind to peptides printed onto slides for 2 hours at room temperature as described in the Pepstar™ user manual (JPT Technologies). Following extensive washing (5×5 min TBST), slides were incubated with secondary antibodies (donkey anti-mouse IgG, Alexafluor 647 conjugate, 5 µg/mL in 3% BSA-TBST) for 1 hour at room temperature. After extensive washing, (5×5 minutes TBST, 5×5 minutes ultrapure water), slides were dried under a stream of nitrogen and imaged on the Opera Phenix in the 647 nm channel. Images were aligned to peptide array definition file using Galviewer software obtained from JPT Technologies and ImageJ software with control mouse IgG serving as landmarks.

AD Patient Cerebral Spinal Fluid (CSF) Immunoprecipitation

Patient CSF was purchased from PrecisionMed. Protein A beads (SureBeads; Bio-Rad) were blocked in 2% BSA for 1 hour at 24° C. and then washed three times in TBST. Both Tween® 20 (0.02%) and EDTA-free complete protease inhibitors (Roche) were added to the CSF prior to incubation with antibodies. CSF (50 µL) was incubated for 1 hour at 4° C. with 2 µg of antibody. The CSF/antibody mixture was then added to 100 µL of blocked/washed beads and incubated for 18 hours at 4° C. The unbound fraction was collected and the beads were washed three times with 1 mL of wash buffer (50 mM Tris pH7, 100 mM NaCl, 0.5%

TritonX-100) followed by one wash with 1 mL PBS. The bound fraction was then eluted by incubation with 45 µL elution buffer (Pierce) for 10 minutes and neutralized by addition of 5 µL Tris buffer (pH 8.8).

Figure 21:
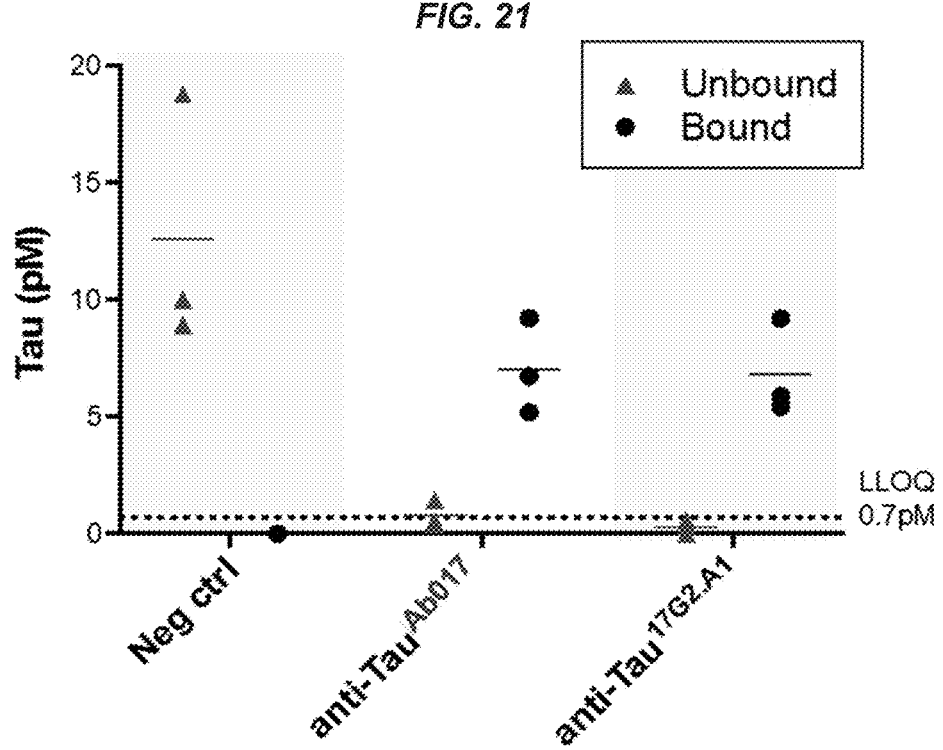
FIG. 21. Anti-Tau 17G2.A1 binds to Tau in human cerebral spinal fluid (CSF) from Alzheimer's disease (AD) patients.

As shown in FIG. 21, both the benchmark anti-Tau Ab017 and anti-Tau 17G2.A1 are capable of binding significant amounts of Tau from human CSF from Alzheimer's disease (AD) patients. Each dot represents a unique AD patient sample and each line indicates the mean of three samples for each of negative control, Ab017, and anti-Tau 17G2.A1.

Example 7. Epitope Mapping Confirmation of 17G2.A1

Direct Binding ELISA

The peptide corresponding to amino acids 186-205 of SEQ ID NO:1 (GEPPKSGDRSGYSSPGSPGT; SEQ ID NO:178) was synthesized as an N-terminal biotinylated peptide. ELISA plates (Corning 3690) were coated with neutravidin (1 µg/ml) and blocked (3% BSA/TBST). The peptides were diluted in 3% BSA/TBST in 0.5 log dilutions starting at 1 µg/mL and bound to neutravidin coated plates. Plates were washed 5× with TBST between all steps. 17G2.A1 was diluted to 5 µg/mL in 3% BSA/TBST and incubated for 1 hour at room temperature, followed by incubation with anti-mouse IgG-HRP (Novex) diluted 1/5000 in BSA/TBST for 45 minutes at room temperature. ELISAs were developed with 50 µL of 1-step TMB Ultra.

Competition Binding ELISA

ELISA plates (Corning 3690) were coated with recombinant Tau (r-Tau) (Tau441; SEQ ID NO:1) (made at Ceptor) in 0.5 log dilutions starting at 5 µg/mL and blocked with 3% BSA/TBST. 17G2.A1 was diluted to 2.5 µg/mL in 3% BSA/TBST and co-incubated with 17G2.A1 peptide (as described above) at decreasing concentrations from 50 µg/mL to 0 µg/mL in 0.5 log steps for 1 hour at room temperature. The plate was then incubated with anti-mouse IgG-HRP (Novex) diluted 1/5000 in BSA/TBST for 45 minutes at room temperature. Plates were washed 5× with TBST between all steps. ELISAs were developed with 50 µL of 1-step TMB Ultra.

Figure 22A:
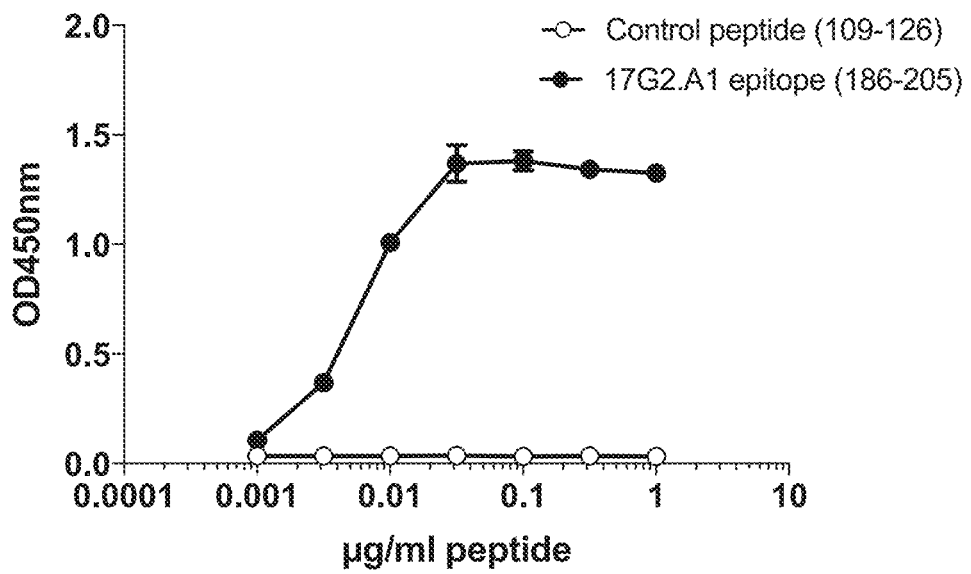
FIGS. 22A and 22B. ELISAs of murine anti-Tau hybridoma antibody 17G2.A1 analyzing direct binding (A) and competition binding (B) of the antibody to epitope GEPPKSGDRSGYSSPGSPGT (SEQ ID NO:178).
Figure 22B:
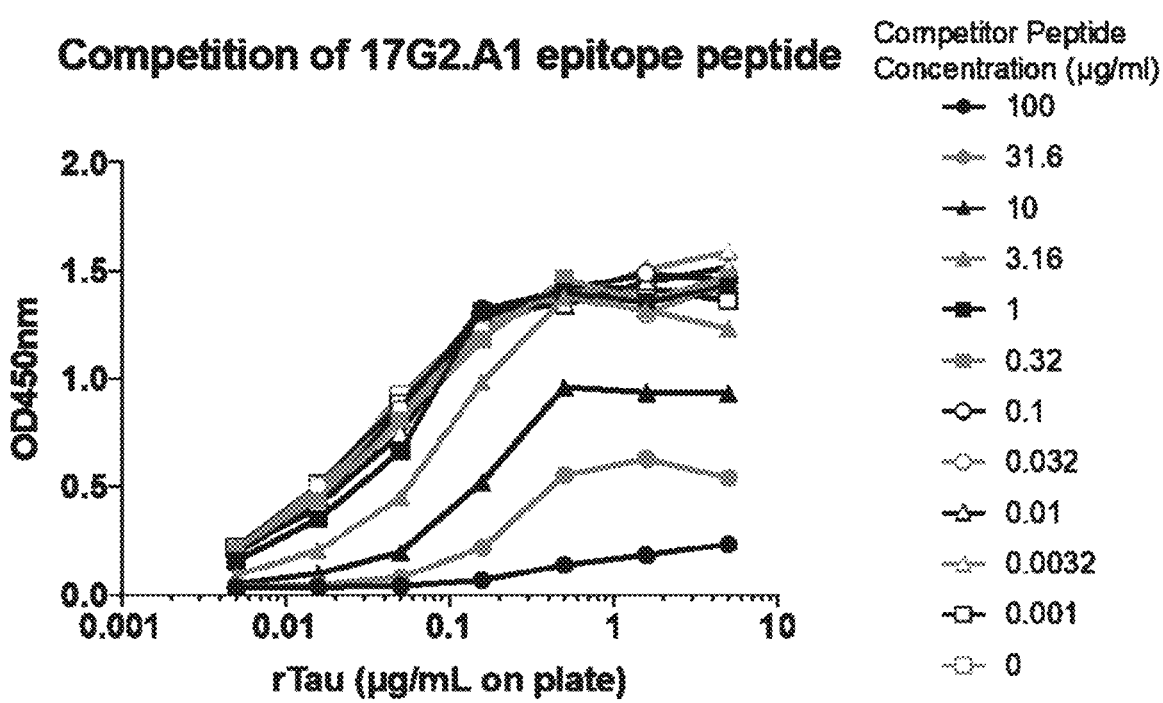

The results of the direct binding and competiton binding ELISAs are shown in FIGS. 22A and 22B. Anti-Tau antibody 17G2.A1 displays specific binding to an epitope within amino acids 186-205 of SEQ ID NO:1. Further, when r-Tau is immobilized on the plate, the epitope peptide GEPPKSGDRSGYSSPGSPGT (SEQ ID NO:178) competes for 17G2.A1 binding in a dose-dependent manner.

Example 8. Modified Fc Polypeptides that Bind to TfR

This example describes modifications to Fc polypeptides to confer transferrin receptor (TfR) binding and transport across the blood-brain barrier (BBB).

Unless otherwise indicated, the positions of amino acid residues in this section are numbered based on EU index numbering for a human IgG1 wild-type Fc region.

Generation and Characterization of Fc Polypeptides Comprising Modifications at Positions 384, 386, 387, 388, 389, 390, 413, 416, and 421 (CH3C Clones)

Yeast libraries containing Fc regions having modifications introduced into positions including amino acid positions 384, 386, 387, 388, 389, 390, 413, 416, and 421 were generated as described below. Illustrative clones that bind to TfR are shown in Tables 13 and 14.

After an additional two rounds of sorting, single clones were sequenced and four unique sequences were identified. These sequences had a conserved Trp at position 388, and all had an aromatic residue (i.e., Trp, Tyr, or His) at position 421. There was a great deal of diversity at other positions.

The four clones selected from the library were expressed as Fc fusions to Fab fragments in CHO or 293 cells, and purified by Protein A and size-exclusion chromatography, and then screened for binding to human TfR in the presence or absence of holo-Tf by ELISA. The clones all bound to human TfR and the binding was not affected by the addition of excess (5 μM) holo-Tf. Clones were also tested for binding to 293F cells, which endogenously express human TfR. The clones bound to 293F cells, although the overall binding was substantially weaker than the high-affinity positive control.

Next, it was tested whether clones could internalize in TfR-expressing cells using clone CH3C.3 as a test clone. Adherent HEK 293 cells were grown in 96-well plates to about 80% confluence, media was removed, and samples were added at 1 μM concentrations: clone CH3C.3, anti-TfR benchmark positive control antibody (Ab204), anti-BACE1 benchmark negative control antibody (Ab107), and human IgG isotype control (obtained from Jackson Immunoresearch). The cells were incubated at 37° C. and 8% $CO_2$ concentration for 30 minutes, then washed, permeabilized with 0.1% Triton™ X-100, and stained with anti-human-IgG-Alexa Fluor® 488 secondary antibody. After additional washing, the cells were imaged under a high content fluorescence microscope (i.e., an Opera Phenix™ system), and the number of puncta per cell was quantified. At 1 clone CH3C.3 showed a similar propensity for internalization to the positive anti-TfR control, while the negative controls showed no internalization.

Further Engineering of Clones

Additional libraries were generated to improve the affinity of the initial hits against human TfR using a soft randomization approach, wherein DNA oligos were generated to introduce soft mutagenesis based on each of the original four hits. Additional clones were identified that bound TfR and were selected. The selected clones fell into two general sequence groups. Group 1 clones (i.e., clones CH3C.18, CH3C.21, CH3C.25, and CH3C.34) had a semi-conserved Leu at position 384, a Leu or His at position 386, a conserved and a semi-conserved Val at positions 387 and 389, respectively, and a semi-conserved P-T-W motif at positions 413, 416, and 421, respectively. Group 2 clones had a conserved Tyr at position 384, the motif TXWSX at positions 386-390, and the conserved motif S/T-E-F at positions 413, 416, and 421, respectively. Clones CH3C.18 and CH3C.35 were used in additional studies as representative members of each sequence group.

Epitope Mapping

To determine whether the engineered Fc regions bound to the apical domain of TfR, TfR apical domain was expressed on the surface of phage. To properly fold and display the apical domain, one of the loops had to be truncated and the sequence needed to be circularly permuted. Clones CH3C.18 and CH3C.35 were coated on ELISA plates and a phage ELISA protocol was followed. Briefly, after washing and blocking with 1% PBSA, dilutions of phage displaying were added and incubated at room temperature for 1 hour. The plates were subsequently washed and anti-M13-HRP was added, and after additional washing the plates were developed with TMB substrate and quenched with 2N $H_2SO_4$. Both clones CH3C.18 and CH3C.35 bound to the apical domain in this assay.

Paratope Mapping

To understand which residues in the Fc domain were most important for TfR binding, a series of mutant clone CH3C.18 and clone CH3C.35 Fc regions was created in which each mutant had a single position in the TfR binding register mutated back to wild-type. The resulting variants were expressed recombinantly as Fab-Fc fusions and tested for binding to human or cyno TfR. For clone CH3C.35, positions 388 and 421 were important for binding; reversion of either of these to wild-type completely ablated binding to human TfR.

Binding Characterization of Maturation Clones

Binding ELISAs were conducted with purified Fab-Fc fusion variants with human or cyno TfR coated on the plate, as described above. The variants from the clone CH3C.18 maturation library, clone CH3C.3.2-1, clone CH3C.3.2-5, and clone CH3C.3.2-19, bound human and cyno TfR with approximately equivalent $EC_{50}$ values, whereas the parent clones CH3C.18 and CH3C.35 had greater than 10-fold better binding to human versus cyno TfR.

Next, it was tested whether the modified Fc polypeptides internalized in human and monkey cells. Using the protocol described above, internalization in human HEK 293 cells and rhesus LLC-MK2 cells was tested. The variants that similarly bound human and cyno TfR, clones CH3C.3.2-5 and CH3C.3.2-19, had significantly improved internalization in LLC-MK2 cells as compared with clone CH3C.35.

Additional Engineering of Clones

Additional engineering to further affinity mature clones CH3C.18 and CH3C.35 involved adding additional mutations to the positions that enhanced binding through direct interactions, second-shell interactions, or structure stabilization. This was achieved via generation and selection from an "NNK walk" or "NNK patch" library. The NNK walk library involved making one-by-one NNK mutations of residues that are near to the paratope. By looking at the structure of Fc bound to FcγRI (PDB ID: 4W4O), 44 residues near the original modification positions were identified as candidates for interrogation. Specifically, the following residues were targeted for NNK mutagenesis: K248, R255, Q342, R344, E345, Q347, T359, K360, N361, Q362, S364, K370, E380, E382, S383, G385, Y391, K392, T393, D399, S400, D401, S403, K409, L410, T411, V412, K414, S415, Q418, Q419, G420, V422, F423, S424, S426, Q438, S440, S442, L443, S444, P4458, G446, and K447. The 44 single point NNK libraries were generated using Kunkel mutagenesis, and the products were pooled and introduced to yeast via electroporation, as described above for other yeast libraries.

The combination of these mini-libraries (each of which had one position mutated, resulting in 20 variants) generated a small library that was selected using yeast surface display for any positions that lead to higher affinity binding. Selections were performed as described above, using TfR apical domain proteins. After three rounds of sorting, clones from the enriched yeast library were sequenced, and several "hot-spot" positions were identified where certain point mutations significantly improved the binding to apical domain proteins. For clone CH3C.35, these mutations included E380 (mutated to Trp, Tyr, Leu, or Gln) and S415 (mutated to Glu). The sequences of the clone CH3C.35 single and combination mutants are set forth in SEQ ID NOS:207-218. For clone CH3C.18, these mutations included E380 (mutated to Trp, Tyr, or Leu) and K392 (mutated to Gln, Phe, or His). The sequences of the clone CH3C.18 single mutants are set forth in SEQ ID NOS:201-206.

Additional Maturation Libraries to Improve Clone CH3C.35 Affinity

An additional library to identify combinations of mutations from the NNK walk library, while adding several additional positions on the periphery of these, was generated as described for previous yeast libraries. In this library, the YxTEWSS (SEQ ID NO:635) and TxxExxxxF (SEQ ID NO:636) motifs were kept constant, and six positions were completely randomized: E380, K392, K414, S415, S424, and S426. Positions E380 and S415 were included because they were "hot spots" in the NNK walk library. Positions K392, S424, and S426 were included because they make up part of the core that may position the binding region, while K414 was selected due to its adjacency to position 415.

This library was sorted, as previously described, with the cyno TfR apical domain only. The enriched pool was sequenced after five rounds, and the sequences of the modified regions of the identified unique clones are set forth in SEQ ID NOS:222-239.

The next libraries were designed to further explore acceptable diversity in the main binding paratope. Each of the original positions (384, 386, 387, 388, 389, 390, 413, 416, and 421) plus the two hot spots (380 and 415) were individually randomized with NNK codons to generate a series of single-position saturation mutagenesis libraries on yeast. In addition, each position was individually reverted to the wild-type residue, and these individual clones were displayed on yeast. It was noted that positions 380, 389, 390, and 415 were the only positions that retained substantial binding to TfR upon reversion to the wild-type residue (some residual but greatly diminished binding was observed for reversion of 413 to wild-type).

The single-position NNK libraries were sorted for three rounds against the human TfR apical domain to collect the top ~5% of binders, and then at least 16 clones were sequenced from each library. The results indicate what amino acids at each position can be tolerated without significantly reducing binding to human TfR, in the context of clone CH3C.35. A summary is below:

Position 380: Trp, Leu, or Glu;
Position 384: Tyr or Phe;
Position 386: Thr only;
Position 387: Glu only;
Position 388: Trp only;
Position 389: Ser, Ala, or Val (although the wild type Asn residue seems to retain some binding, it did not appear following library sorting);
Position 390: Ser or Asn;
Position 413: Thr or Ser;
Position 415: Glu or Ser;
Position 416: Glu only; and
Position 421: Phe only.

The above residues, when substituted into clone CH3C.35 as single changes or in combinations, represent paratope diversity that retains binding to TfR apical domain. Clones having mutations at these positions include those shown in Table 14, and the sequences of the CH3 domains of these clones are set forth in SEQ ID NOS:214-218, 238, 240-270, and 469-475.

Example 9. Additional Fc Positions that can be Modified to Confer TfR Binding

Additional modified Fc polypeptides that bind to transferrin receptor (TfR) were generated having modifications at alternative sites in the Fc region, e.g., at the following positions:

positions 274, 276, 283, 285, 286, 287, 288, and 290 (CH2A2 clones);

positions 266, 267, 268, 269, 270, 271, 295, 297, 298, and 299 (CH2C clones);

positions 268, 269, 270, 271, 272, 292, 293, 294, and 300 (CH2D clones);

positions 272, 274, 276, 322, 324, 326, 329, 330, and 331 (CH2E3 clones); or positions 345, 346, 347, 349, 437, 438, 439, and 440 (CH3B clones).

Illustrative CH3B clones that bind to TfR are set forth in SEQ ID NOS:289-293. Illustrative CH2A2 clones that bind to TfR are set forth in SEQ ID NOS:394-398. Illustrative CH2C clones that bind to TfR are set forth in SEQ ID NOS:299-303. Illustrative CH2D clones that bind to TfR are set forth in SEQ ID NOS:304-308. Illustrative CH2E3 clones that bind to TfR are set forth in SEQ ID NOS:309-313.

Example 10. Binding of Anti-Tau Antibody Comprising Modified Fc Polypeptides

Generation of Anti-Tau Fab Fused to BBB-Penetrating Fc Polypeptide

The first of the two heavy chains was constructed by cloning the Fd (VH+CH1 regions) of clone 1C7 into an expression vector comprising an Fc engineered to bind to transferrin receptor and also comprising a "knob" mutation (T366W) to prevent homodimerization and promote heterodimerization with an Fc comprising "hole" mutations (T366W/L368A/Y407V). The Fc also comprises L234A, L235A, and P329G substitutions (according to the EU numbering scheme) to alter effector function. The first of the two heavy chains was designed to express the sequence of SEQ ID NO:317.

The second of the two heavy chains was constructed by cloning the Fd (VH+CH1 regions) of clone 1C7 into an expression vector comprising an Fc comprising "hole" mutations (T366W/L368A/Y407V), but lacking the transferrin receptor binding mutations. The Fc also comprises L234A, L235A, and P329G substitutions (according to the EU numbering scheme) to alter effector function. The second of the two heavy chains was designed to express the sequence of SEQ ID NO:316.

The light chain was constructed using an expression vector comprising a polynucleotide corresponding to the sequence of SEQ ID NO:315.

The vectors comprising polynucleotides encoding aforementioned sequences of SEQ ID NOS:315-317 were co-transfected to ExpiCHO or Expi293 cells in the ratio of 1:1:2 (first heavy chain:second heavy chain:light chain). The expressed antibody (referred to "1C7/3C.35.21" herein) was purified by Protein A chromatography followed by preparative size-exclusion chromatography (SEC) by methods familiar to those with skill in the art.

Tau/Transferrin Receptor (TfR) Binding

Simultaneous binding of recombinant Tau and TfR to 1C7/3C.35.21 was evaluated using a ForteBio® Octet® RED384 instrument with ForteBio® Streptavidin biosensors (ForteBio, 18-5019). Biotinylated recombinant Tau was diluted to a concentration of 10 μg/mL in kinetic buffer (obtained from ForteBio®) and captured onto a Streptavidin biosensor for 70 seconds. A baseline was then established for 1 minute in kinetic buffer. Anti-Tau antibody 1C7/3C.35.21 (50 μg/mL) was then bound to the immobilized recombinant Tau. The loaded biosensor was subsequently dipped into kinetic buffer to establish a new baseline. Recombinant human TfR (50 ng/mL) binding was measured for 1 minute on sensors with or without pre-bound recombinant Tau or 1C7/3C.35.21.

Biacore Assessment of Anti-Tau Antibody 1C7/3C.35.21

The affinities of anti-Tau antibody 1C7/3C.35.21 for recombinant Tau and TfR were determined by surface plasmon resonance using a Biacore™ T200 instrument. Similar experimental protocols were used as described in previous examples.

Tau Seeding Experiment

Cell Culture and Assay

FRET sensor cells (Tau RD P301S FRET Biosensor, Catalog: CRL-3275, ATCC) were plated on poly-D-lysine (PDL)-coated 96-well plate (Corning BioCoat Poly-D-Lysine Multi-well Plates, Catalog: 356640) at the density of 30,000/well in 100 μL/well DMEM (DMEM High Glucose (Thermo Fisher Scientific; Catalog: 11-965-092) supplemented with 10% HI-FBS (Thermo Fisher Scientific; Catalog: 10082-147), 1×MEM Non-Essential Amino Acids Solution (Thermo Fisher Scientific; Catalog: 11-140-050), 1 mM sodium pyruvate (Thermo Fisher Scientific; Catalog: 11-360-070), and 1× Penicillin-Streptomycin-Glutamine (Thermo Fisher Scientific; Catalog: 10-378-016), and maintained at 37° C. with 5% $CO_2$.

Four to five hours after plating cells, the soluble fraction of human AD patient brain lysate and various antibodies, including negative control, chimeric IgG clone 1C7, and anti-Tau antibody 1C7/3C.35.21, were co-transfected using Lipofectamine 2000. The PBS-soluble fraction from AD patients' brain or age-matched healthy control brain containing 1 μg total protein (about 0.2 ng Tau protein) and the antibodies (2 μg) were diluted in 25 μL OPTI-MEM (Thermo Fisher Scientific, Catalog: 31-985-088) and incubated at 37° C. for 20 minutes. 25 μL OPTI-MEM containing 0.5 μL Lipofecatmine 2000 (Thermo Fisher Scientific, Catalog: 11-668-019) was then added to the protein-antibody mixture and further incubated at RT for 10 minutes. For each well, the media was entirely replaced with the transfection mixture and FRET sensor cells were kept at 37° C. with 5% $CO_2$ for 24 hours. FRET sensor cells transfected with protein seeds with or without the antibodies were then fixed in 1×PBS (Teknova, Catalog: P0191) containing 4% PFA (Electron Microscopy Sciences, Catalog: 15714-S) and 4% sucrose (Thermo Fisher Scientific, Catalog: S5-3) for 15 minutes at RT, followed by 4× wash with 1×PBS. Cells were then stained with CellMask Deep Red Plasma Membrane Stain (Thermo Fisher Scientific, Catalog: C10046) in 1×PBS with 0.2% TritonX-100 for 10 minutes at RT right before imaging, followed by 2× wash with 1×PBS.

FRET Quantification

Fixed FRET sensor cells were imaged using the Opera Phenix High Content Screening System (PerkinElmer) and images were quantified using the Harmony software (PerkinElmer). To acquire FRET images, built-in CFP/YFP FRET acquisition protocol (excitation at 425 nm, donor emission at 435-480 nm, and acceptor emission at 500-550 nm), Alexa647 acquisition protocol (excitation at 640 nm, and emission at 650-760 nm), and water-immersion 20× objective (NA=1.0) under the non-confocal mode were used. FRET intensity was defined by the ratio of acceptor fluorescence to donor fluorescence (FRET=acceptor/donor) per each pixel. Cells were defined by Cell Mask staining. Mean FRET intensity was then calculated per each cell and histogram showing the distribution of the mean FRET intensity (per cell) was generated per each condition (e.g., cells transfected with AD patients' brain without antibody). The threshold to determine FRET positive cells was arbitrarily set around the highest mean FRET values of FRET sensor cells that were transfected with healthy control subjects' brain without antibodies (typically mean FRET intensity is greater than 2.5-2.6). FRET signal of FRET-positive cells was integrated (iFRET: integrated FRET) and normalized by integrated FRET intensity of all the cells per each well.

Results

Figure 23A:
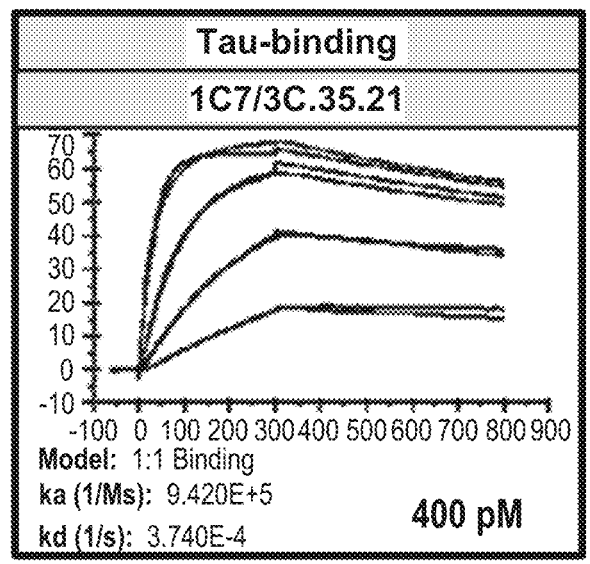
FIGS. 23A-23C. Representative sensorgrams of anti-Tau antibody 1C7/3C.35.21 binding to human Tau (400 pM) (A), chimeric IgG clone 1C7 binding to human Tau (440 pM) (B), and anti-Tau antibody 1C7/3C.35.21 binding to transferrin receptor (TfR) (C).
Figure 23B:
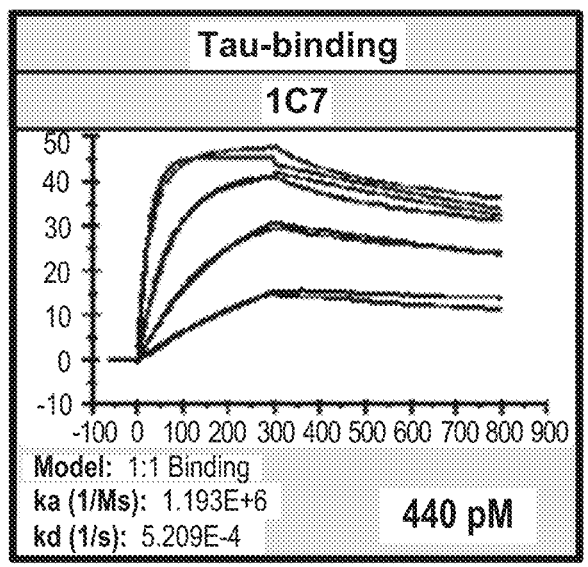
Figure 23C:
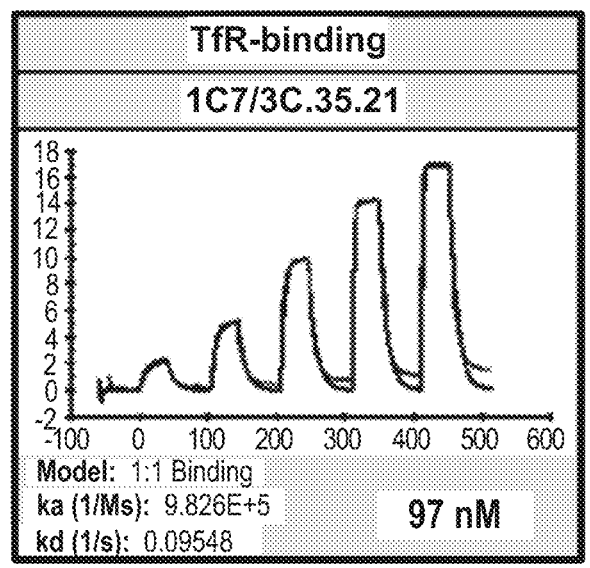
Figure 24:
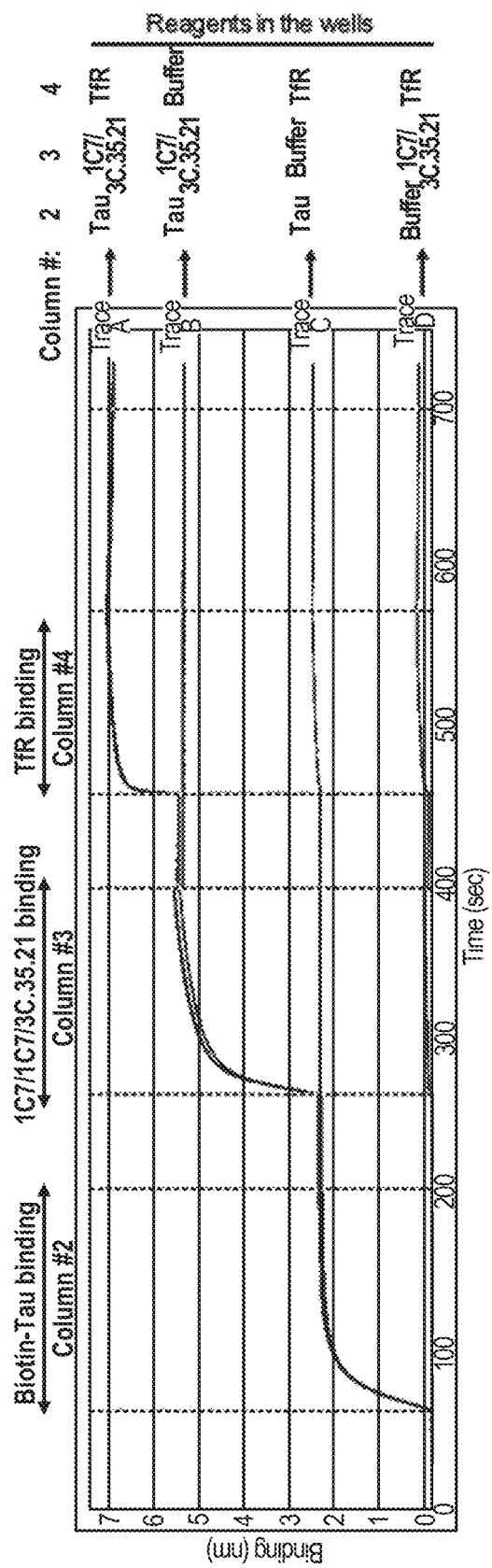
FIG. 24. A representative sensorgram showing that anti-Tau antibody 1C7/3C.35.21 binds to Tau and TfR (trace A) or Tau alone (trace B). No interaction is observed between Tau and TfR in the absence of 1C7/3C.35.21 (trace C) and neither 1C7/3C.35.21 nor TfR bind to sensor tips nonspecifically (trace D).
Figure 25:
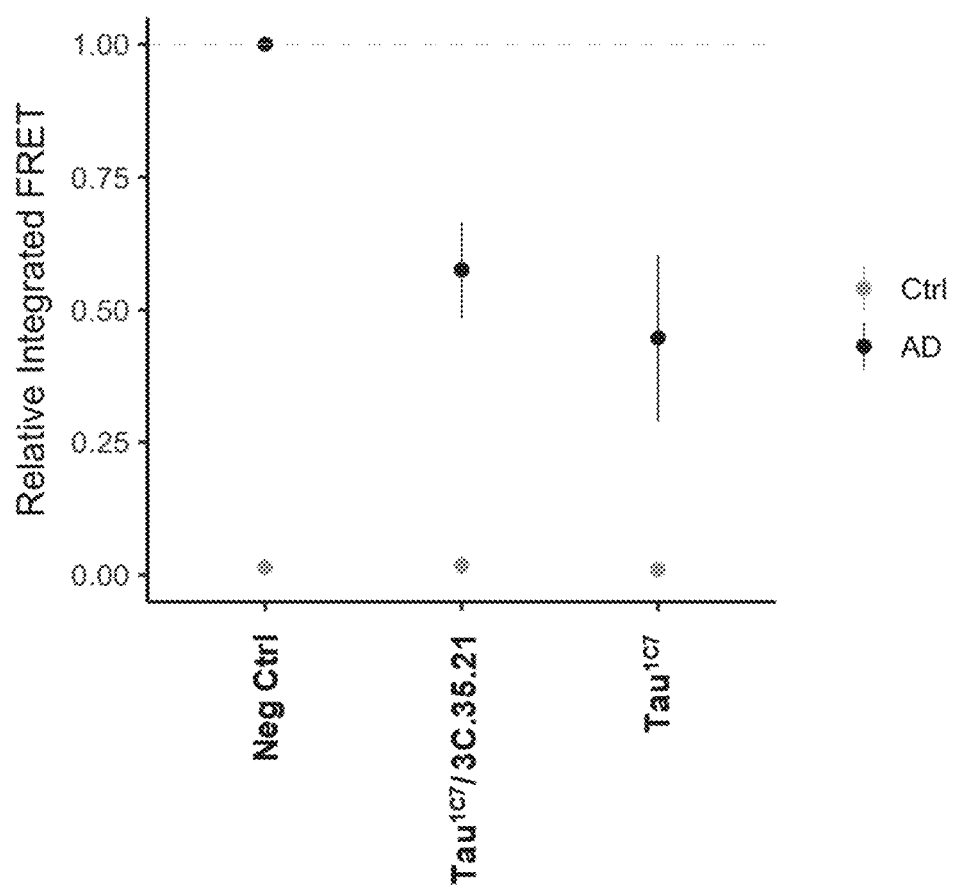
FIG. 25. Chimeric IgG clones 1C7 (Tau$^{1C7}$) and Tau$^{1C7/3C.35.21}$ inhibit Tau seeding by human brain lysate. Pre-incubation of Tau antibodies with brain lysate inhibited seeding and aggregation of Tau for Tau$^{1C7}$ and Tau$^{1C7/3C.35.21}$.

FIGS. 23A-23C show the SPR analysis of anti-Tau antibody 1C7/3C.35.21 and chimeric IgG clone 1C7 binding to human Tau and human TfR. The anti-Tau antibody 1C7/3C.35.21 bound to both Tau and TfR. The binding affinity of 1C7/3C.35.21 to Tau was comparable to the affinity of chimeric IgG clone 1C7 to Tau. FIG. 24 shows that anti-Tau antibody 1C7/3C.35.21 was capable of binding to both Tau and TfR simultaneously. Biotin-Tau was first bound to the Octet streptavidin sensor, and the sensor tips were then dipped into 1C7/3C.35.21 and TfR solutions sequentially. Representative sensorgrams in FIG. 24 show that 1C7/3C.35.21 bound to Tau and TfR (trace A) or Tau alone (trace B). No interaction was observed between Tau and TfR in the absence of 1C7/3C.35.21 (trace C) and neither 1C7/3C.35.21 nor TfR bound to sensor tips non-specifically (trace D). FIG. 25 shows that anti-Tau antibody 1C7/3C.35.21 prevented Tau seeding in HEK293T cells. AD brain lysate seeded Tau aggregation in the Tau Biosensor FRET, but this seeding was blocked by the addition of either chimeric IgG clone 1C7 (Tau$^{1C7}$ or 1C7/3C.35.21 (Tau$^{1C7/3C.35.21}$).

Example 11. Methods

Generation of Phage-Display Libraries

A DNA template coding for the wild-type human Fc sequence was synthesized and incorporated into a phagemid vector. The phagemid vector contained an ompA or pelB leader sequence, the Fc insert fused to c-Myc and 6×His epitope tags, and an amber stop codon followed by M13 coat protein pIII.

Primers containing "NNK" tricodons at the desired positions for modifications were generated, where N is any DNA base (i.e., A, C, G, or T) and K is either G or T. Alternatively, primers for "soft" randomization were used, where a mix of bases corresponding to 70% wild-type base and 10% of each of the other three bases was used for each randomization position. Libraries were generated by performing PCR amplification of fragments of the Fc region corresponding to regions of randomization and then assembled using end primers containing SfiI restriction sites, then digested with SfiI and ligated into the phagemid vectors. Alternatively, the primers were used to conduct Kunkel mutagenesis. The ligated products or Kunkel products were transformed into electrocompetent E. coli cells of strain TG1 (obtained from Lucigen®). The E. coli cells were infected with M13K07 helper phage after recovery and grown overnight, after which library phage were precipitated with 5% PEG/NaCl, resuspended in 15% glycerol in PBS, and frozen until use. Typical library sizes ranged from about $10^9$ to about $10^{11}$ transformants. Fc-dimers were displayed on phage via pairing between pIII-fused Fc and soluble Fc not attached to pIII (the latter being generated due to the amber stop codon before pIII).

Generation of Yeast-Display Libraries

A DNA template coding for the wild-type human Fc sequence was synthesized and incorporated into a yeast display vector. For CH2 and CH3 libraries, the Fc polypeptides were displayed on the Aga2p cell wall protein. Both vectors contained prepro leader peptides with a Kex2 cleavage sequence, and a c-Myc epitope tag fused to the terminus of the Fc.

Yeast display libraries were assembled using methods similar to those described for the phage libraries, except that amplification of fragments was performed with primers containing homologous ends for the vector. Freshly prepared electrocompetent yeast (i.e., strain EBY100) were electroporated with linearized vector and assembled library inserts. Electroporation methods will be known to one of skill in the art. After recovery in selective SD-CAA media, the yeast were grown to confluence and split twice, then induced for protein expression by transferring to SG-CAA media. Typical library sizes ranged from about $10^7$ to about $10^9$ transformants. Fc-dimers were formed by pairing of adjacently displayed Fc monomers.

General Methods for Phage Selection

Phage methods were adapted from Phage Display: A Laboratory Manual (Barbas, 2001). Additional protocol details can be obtained from this reference.

Plate Sorting Methods

Human TfR target was coated on MaxiSorp® microtiter plates (typically 200 µL at 1-10 µg/mL in PBS) overnight at 4° C. All binding was done at room temperature unless otherwise specified. The phage libraries were added into each well and incubated overnight for binding. Microtiter wells were washed extensively with PBS containing 0.05% Tween® 20 (PBST) and bound phage were eluted by incubating the wells with acid (typically 50 mM HCl with 500 mM KCl, or 100 mM glycine, pH 2.7) for 30 minutes. Eluted phage were neutralized with 1 M Tris (pH 8) and amplified using TG1 cells and M13/K07 helper phage and grown overnight at 37° C. in 2YT media containing 50 µg/mL carbenacillin and 50 µg/mL Kanamycin. The titers of phage eluted from a target-containing well were compared to titers of phage recovered from a non-target-containing well to assess enrichment. Selection stringency was increased by subsequently decreasing the incubation time during binding and increasing washing time and number of washes.

Bead Sorting Methods

Antigen was biotinylated through free amines using NHS-PEG4-Biotin (obtained from Pierce™). For biotinylation reactions, a 3- to 5-fold molar excess of biotin reagent was used in PBS. Reactions were quenched with Tris followed by extensive dialysis in PBS. The biotinylated antigen was immobilized on streptavidin-coated magnetic beads, (i.e., M280-streptavidin beads obtained Thermo Fisher). The phage display libraries were incubated with the antigen-coated beads at room temperature for 1 hour. The unbound phage were then removed and beads were washed with PBST. The bound phage were eluted by incubating with 50 mM HCl containing 500 mM KCl (or 0.1 M glycine, pH 2.7) for 30 minutes, and then neutralized and propagated as described above for plate sorting.

After three to five rounds of panning, single clones were screened by either expressing Fc on phage or solubly in the E. coli periplasm. Such expression methods will be known to one of skill in the art. Individual phage supernatants or periplasmic extracts were exposed to blocked ELISA plates coated with antigen or a negative control and were subsequently detected using HRP-conjugated goat anti-Fc (obtained from Jackson Immunoresearch) for periplasmic extracts or anti-M13 (GE Healthcare) for phage, and then developed with TMB reagent (obtained from Thermo Fisher). Wells with OD$_{450}$ values greater than around 5-fold over background were considered positive clones and sequenced, after which some clones were expressed either as a soluble Fc fragment or fused to Fab fragments.

General Methods for Yeast Selection

Bead Sorting (Magnetic-Assisted Cell Sorting (MACS)) Methods

MACS and FACS selections were performed similarly to as described in Ackerman, et al. 2009 Biotechnol. Prog. 25(3), 774. Streptavidin magnetic beads (e.g., M-280 streptavidin beads from Thermo Fisher) were labeled with biotinylated antigen and incubated with yeast (typically 5-10× library diversity). Unbound yeast were removed, the beads were washed, and bound yeast were grown in selective media and induced for subsequent rounds of selection.

Fluorescence-Activated Cell Sorting (FACS) Methods

Yeast were labeled with anti-c-Myc antibody to monitor expression and biotinylated antigen (concentration varied depending on the sorting round). In some experiments, the antigen was pre-mixed with streptavidin-Alexa Fluor® 647 in order to enhance the avidity of the interaction. In other experiments, the biotinylated antigen was detected after binding and washing with streptavidin-Alexa Fluor® 647. Singlet yeast with binding were sorted using a FACS Aria III cell sorter. The sorted yeast were grown in selective media then induced for subsequent selection rounds.

After an enriched yeast population was achieved, yeast were plated on SD-CAA agar plates and single colonies were grown and induced for expression, then labeled as described above to determine their propensity to bind to the target. Positive single clones were subsequently sequenced for binding antigen, after which some clones were expressed either as a soluble Fc fragment or as fused to Fab fragments.

General Methods for Screening

Screening by ELISA

Clones were selected from panning outputs and grown in individual wells of 96-well deep-well plates. The clones were either induced for periplasmic expression using auto-induction media (obtained from EMD Millipore) or infected with helper phage for phage-display of the individual Fc variants on phage. The cultures were grown overnight and spun to pellet E. coli. For phage ELISA, phage containing supernatant was used directly. For periplasmic expression, pellets were resuspended in 20% sucrose, followed by dilution at 4:1 with water, and shaken at 4° C. for 1 hour. Plates were spun to pellet the solids and supernatant was used in the ELISA.

ELISA plates were coated with antigen, typically at 0.5 mg/mL overnight, then blocked with 1% BSA before addition of phage or periplasmic extracts. After a 1-hour incubation and washing off unbound protein, HRP-conjugated secondary antibody was added (i.e., anti-Fc or anti-M13 for soluble Fc or phage-displayed Fc, respectively) and incubated for 30 minutes. The plates were washed again, and then developed with TMB reagent and quenched with 2N sulfuric acid. Absorbance at 450 nm was quantified using a plate reader (BioTek®) and binding curves were polotted using Prism software where applicable. Absorbance signal for tested clones was compared to negative control (phage or paraplasmic extract lacking Fc). In some assays, soluble transferrin or other competitor was added during the binding step, typically at significant molar excess (greater than 10-fold excess).

Screening by Flow Cytometry

Fc variant polypeptides (expressed either on phage, in periplasmic extracts, or solubly as fusions to Fab fragments) were added to cells in 96-well V-bottom plates (about 100,000 cells per well in PBS+1% BSA (PBSA)), and incubated at 4° C. for 1 hour. The plates were subsequently spun and the media was removed, and then the cells were washed once with PBSA. The cells were resuspended in PBSA containing secondary antibody (typically goat anti-human-IgG-Alexa Fluor 647 (obtained from Thermo Fisher)). After 30 minutes, the plates were spun and the media was removed, the cells were washed 1-2 times with PBSA, and then the plates were read on a flow cytometer (i.e., a FACSCanto™ II flow cytometer). Median fluorescence values were calculated for each condition using FlowJo software and binding curves were plotted with Prism software.

The amino acid substitutions for each clone described in the Tables (e.g., Table 14) dictate the amino acid substitutions at the register positions of that clone over the amino acids found in the sequence set forth in the Sequence Listing, in case of discrepancy.

It is understood that the examples and embodiments described herein are for illustrative purposes only and that various modifications or changes in light thereof will be suggested to persons skilled in the art and are to be included within the spirit and purview of this application and scope of the appended claims.

TABLE 12

EPITOPE MAPPING FOR CLONES 1C7, 1A1, 1A5, 1D10, AND 1G7

| Name | SEQ ID NO: | ID | 1C7 binding | 1A1 binding | 1A5 binding | 1D10 binding | 1G7 binding | 17G2.A1 binding |
|---|---|---|---|---|---|---|---|---|
| Peptide_012 | 57 | SEEPGSETSDAKSTP | No | No | No | No | No | No |
| Peptide_011 | 58 | PTEDGSEEPGSETSD | No | No | No | No | No | No |
| Peptide_010 | 59 | SPLQTPTEDGSEEPG | No | No | No | No | No | No |
| Peptide_009 | 60 | AGLKESPLQTPTEDG | No | No | No | No | No | No |
| Peptide_008 | 61 | EGDTDAGLKESPLQT | No | No | No | No | No | No |
| Peptide_007 | 62 | MHQDQEGDTDAGLKE | No | No | No | No | No | No |
| Peptide_006 | 63 | QGGYTMHQDQEGDTD | No | No | No | No | No | No |
| Peptide_005 | 64 | GDRKDQGGYTMHQDQ | No | No | No | No | No | No |
| Peptide_004 | 65 | GTYGLGDRKDQGGYT | No | No | No | No | No | No |

TABLE 12-continued

EPITOPE MAPPING FOR CLONES 1C7, 1A1, 1A5, 1D10, AND 1G7

| Name | SEQ ID NO: | ID | 1C7 binding | 1A1 binding | 1A5 binding | 1D10 binding | 1G7 binding | 17G2.A1 binding |
|---|---|---|---|---|---|---|---|---|
| Peptide_003 | 66 | MEDHAGTYGLGDRKD | No | No | No | No | No | No |
| Peptide_002 | 67 | QEFEVMEDHAGTYGL | No | No | No | No | No | No |
| Peptide_001 | 68 | MAEPRQEFEVMEDHA | No | No | No | No | No | No |
| Peptide_024 | 69 | DEAAGHVTQARMVSK | No | No | No | No | No | No |
| Peptide_023 | 70 | TPSLEDEAAGHVTQA | Yes | No | No | No | No | No |
| Peptide_022 | 71 | AGIGDTPSLEDEAAG | No | No | No | No | No | No |
| Peptide_021 | 72 | TTAEEAGIGDTPSLE | No | No | No | No | No | No |
| Peptide_020 | 73 | EIPEGTTAEEAGIGD | No | No | No | No | No | No |
| Peptide_019 | 74 | AQPHTEIPEGTTAEE | No | No | No | No | No | No |
| Peptide_018 | 75 | GKQAAAQPHTEIPEG | No | No | No | No | No | No |
| Peptide_017 | 76 | DEGAPGKQAAAQPHT | No | No | No | No | No | No |
| Peptide_016 | 77 | TAPLVDEGAPGKQAA | No | No | No | No | No | No |
| Peptide_015 | 78 | TAEDVTAPLVDEGAP | No | No | No | No | No | No |
| Peptide_014 | 79 | AKSTPTAEDVTAPLV | No | No | No | No | No | No |
| Peptide_013 | 80 | SETSDAKSTPTAEDV | No | No | No | No | No | No |
| Peptide_036 | 81 | PPAPKTPPSSGEPPK | No | No | No | No | No | No |
| Peptide_035 | 82 | IPAKTPPAPKTPPSS | No | No | No | No | No | No |
| Peptide_034 | 83 | ANATRIPAKTPPAPK | No | No | No | No | No | No |
| Peptide_033 | 84 | GQKGQANATRIPAKT | No | No | No | No | No | No |
| Peptide_032 | 85 | GAAPPGQKGQANATR | No | No | No | No | No | No |
| Peptide_031 | 86 | IATPRGAAPPGQKGQ | No | No | No | No | No | No |
| Peptide_030 | 87 | DGKTKIATPRGAAPP | No | No | No | No | No | No |
| Peptide_029 | 88 | KAKGADGKTKIATPR | No | No | No | No | No | No |
| Peptide_028 | 89 | GSDDKKAKGADGKTK | No | No | No | No | No | No |
| Peptide_027 | 90 | SKDGTGSDDKKAKGA | No | No | No | No | No | No |
| Peptide_026 | 91 | RMVSKSKDGTGSDDK | No | No | No | No | No | No |
| Peptide_025 | 92 | HVTQARMVSKSKDGT | No | No | No | No | No | No |
| process-control | 93 | GGSGGGSDYKDDDDK | No | No | No | No | No | No |
| Peptide_047 | 94 | TPPKSPSSAKSRLQT | No | No | No | No | No | No |
| Peptide_046 | 95 | VAVVRTPPKSPSSAK | No | No | No | No | No | No |
| Peptide_045 | 96 | REPKKVAVVRTPPKS | No | No | No | No | No | No |
| Peptide_044 | 97 | PTPPTREPKKVAVVR | No | No | No | No | No | No |
| Peptide_043 | 98 | RTPSLPTPPTREPKK | No | No | No | No | No | No |
| Peptide_042 | 99 | PGSRSRTPSLPTPPT | No | No | No | No | No | No |
| Peptide_041 | 100 | GSPGTPGSRSRTPSL | No | No | No | No | No | No |
| Peptide_040 | 101 | GYSSPGSPGTPGSRS | No | No | No | No | No | No |
| Peptide_039 | 102 | SGDRSGYSSPGSPGT | No | No | No | No | No | Yes |

TABLE 12-continued

EPITOPE MAPPING FOR CLONES 1C7, 1A1, 1A5, 1D10, AND 1G7

| Name | SEQ ID NO: | ID | 1C7 binding | 1A1 binding | 1A5 binding | 1D10 binding | 1G7 binding | 17G2.A1 binding |
|---|---|---|---|---|---|---|---|---|
| Peptide_038 | 103 | GEPPKSGDRSGYSSP | No | No | No | No | No | Yes |
| Peptide_037 | 104 | TPPSSGEPPKSGDRS | No | No | No | No | No | No |
| Peptide_059 | 105 | CGSKDNIKHVPGGGS | No | No | No | No | No | No |
| Peptide_058 | 106 | NVQSKCGSKDNIKHV | No | No | No | No | No | No |
| Peptide_057 | 107 | KLDLSNVQSKCGSKD | No | No | No | No | No | No |
| Peptide_056 | 108 | QIINKKLDLSNVQSK | No | No | No | No | No | No |
| Peptide_055 | 109 | GGGKVQIINKKLDLS | No | No | No | No | No | No |
| Peptide_054 | 110 | LKHQPGGGKVQIINK | No | No | No | No | No | No |
| Peptide_053 | 111 | GSTENLKHQPGGGKV | No | No | No | No | No | No |
| Peptide_052 | 112 | VKSKIGSTENLKHQP | No | Yes | Yes | Yes | Yes | No |
| Peptide_051 | 113 | PDLKNVKSKIGSTEN | No | Yes | Yes | Yes | Yes | No |
| Peptide_050 | 114 | APVPMPDLKNVKSKI | No | No | No | No | No | No |
| Peptide_049 | 115 | SRLQTAPVPMPDLKN | No | No | No | No | No | No |
| Peptide_048 | 116 | PSSAKSRLQTAPVPM | No | No | No | No | No | No |
| blank-control | | AA | No | No | No | No | No | No |
| Peptide_070 | 117 | FKDRVQSKIGSLDNI | No | Yes | Yes | Yes | Yes | No |
| Peptide_069 | 118 | SEKLDFKDRVQSKIG | No | No | No | No | No | No |
| Peptide_068 | 119 | QVEVKSEKLDFKDRV | No | No | No | No | No | No |
| Peptide_067 | 120 | KPGGGQVEVKSEKLD | No | No | No | No | No | No |
| Peptide_066 | 121 | GNIHHKPGGGQVEVK | No | No | No | No | No | No |
| Peptide_065 | 122 | KCGSLGNIHHKPGGG | No | No | No | No | No | No |
| Peptide_064 | 123 | SKVTSKCGSLGNIHH | No | No | No | No | No | No |
| Peptide_063 | 124 | KPVDLSKVTSKCGSL | No | No | No | No | No | No |
| Peptide_062 | 125 | VQIVYKPVDLSKVTS | No | No | No | No | No | No |
| Peptide_061 | 126 | PGGGSVQIVYKPVDL | No | No | No | No | No | No |
| Peptide_060 | 127 | NIKHVPGGGSVQIVY | No | No | No | No | No | No |
| Peptide_082 | 128 | RHLSNVSSTGSIDMV | No | No | No | No | No | No |
| Peptide_081 | 129 | GDTSPRHLSNVSSTG | No | No | No | No | No | No |
| Peptide_080 | 130 | SPVVSGDTSPRHLSN | No | No | No | No | No | No |
| Peptide_079 | 131 | EIVYKSPVVSGDTSP | No | No | No | No | No | No |
| Peptide_078 | 132 | TDHGAEIVYKSPVVS | No | No | No | No | No | No |
| Peptide_077 | 133 | NAKAKTDHGAEIVYK | No | No | No | No | No | No |
| Peptide_076 | 134 | LTFRENAKAKTDHGA | No | No | No | No | No | No |
| Peptide_075 | 135 | IETHKLTFRENAKAK | No | No | No | No | No | No |
| Peptide_074 | 136 | GGNKKIETHKLTFRE | No | No | No | No | No | No |
| Peptide_073 | 137 | THVPGGGNKKIETHK | No | No | No | No | No | No |
| Peptide_072 | 138 | SLDNITHVPGGGNKK | No | No | No | No | No | No |
| Peptide_071 | 139 | QSKIGSLDNITHVPG | No | No | No | No | No | No |

TABLE 12-continued

EPITOPE MAPPING FOR CLONES 1C7, 1A1, 1A5, 1D10, AND 1G7

| Name | SEQ ID NO: | ID | 1C7 binding | 1A1 binding | 1A5 binding | 1D10 binding | 1G7 binding | 17G2.A1 binding |
|---|---|---|---|---|---|---|---|---|
| Peptide_087 | 140 | TLADEVSASLAKQGL | No | No | No | No | No | No |
| Peptide_086 | 141 | ATLADEVSASLAKQG | No | No | No | No | No | No |
| Peptide_085 | 142 | DSPQLATLADEVSAS | No | No | No | No | No | No |
| Peptide_084 | 143 | SIDMVDSPQLATLAD | No | No | No | No | No | No |
| Peptide_083 | 144 | VSSTGSIDMVDSPQL | No | No | No | No | No | No |

TABLE 13

CH3 DOMAIN MODIFICATIONS

| Clone name | Group | 384 | 385 | 386 | 387 | 388 | 389 | 390 | 391 | ... | 413 | 414 | 415 | 416 | 417 | 418 | 419 | 420 | 421 |
|---|---|---|---|---|---|---|---|---|---|---|---|---|---|---|---|---|---|---|---|
| Wild-type | n/a | N | G | Q | P | E | N | N | Y | ... | D | K | S | R | W | Q | Q | G | N |
| 1 | | L | G | L | V | W | V | G | Y | ... | A | K | S | T | W | Q | Q | G | W |
| 2 | | Y | G | T | V | W | S | H | Y | ... | S | K | S | E | W | Q | Q | G | Y |
| 3 | | Y | G | T | E | W | S | Q | Y | ... | E | K | S | D | W | Q | Q | G | H |
| 4 | | V | G | T | P | W | A | L | Y | ... | L | K | S | E | W | Q | Q | G | W |
| 17 | 2 | Y | G | T | V | W | S | K | Y | ... | S | K | S | E | W | Q | Q | G | F |
| 18 | 1 | L | G | H | V | W | A | V | Y | ... | P | K | S | T | W | Q | Q | G | W |
| 21 | 1 | L | G | L | V | W | V | G | Y | ... | P | K | S | T | W | Q | Q | G | W |
| 25 | 1 | M | G | H | V | W | V | G | Y | ... | D | K | S | T | W | Q | Q | G | W |
| 34 | 1 | L | G | L | V | W | V | F | S | ... | P | K | S | T | W | Q | Q | G | W |
| 35 | 2 | Y | G | T | E | W | S | S | Y | ... | T | K | S | E | W | Q | Q | G | F |
| 44 | 2 | Y | G | T | E | W | S | N | Y | ... | S | K | S | E | W | Q | Q | G | F |
| 51 | 1/2 | L | G | H | V | W | V | G | Y | ... | S | K | S | E | W | Q | Q | G | W |
| 3.1-3 | 1 | L | G | H | V | W | V | A | T | ... | P | K | S | T | W | Q | Q | G | W |
| 3.1-9 | 1 | L | G | P | V | W | V | H | T | ... | P | K | S | T | W | Q | Q | G | W |
| 3.2-5 | 1 | L | G | H | V | W | V | D | Q | ... | P | K | S | T | W | Q | Q | G | W |
| 3.2-19 | 1 | L | G | H | V | W | V | N | Q | ... | P | K | S | T | W | Q | Q | G | W |
| 3.2-1 | 1 | L | G | H | V | W | V | N | F | ... | P | K | S | T | W | Q | Q | G | W |

TABLE 14

ADDITIONAL CH3 DOMAIN MODIFICATIONS.

| Clone name | 378 | 379 | 380 | 381 | 382 | 383 | 384 | 385 | 386 | 387 | 388 | 389 | 390 | 391 | 392 | 411 | 412 | 413 | 414 | 415 | 416 | 417 | 418 | 419 | 420 | 421 | 422 | 423 |
|---|---|---|---|---|---|---|---|---|---|---|---|---|---|---|---|---|---|---|---|---|---|---|---|---|---|---|---|---|
| Wild-type | A | V | E | W | E | S | N | G | Q | P | E | N | N | Y | K | T | V | D | K | S | R | W | Q | Q | G | N | V | F |
| 35.20.1 | . | . | . | . | . | . | . | . | F | . | T | E | W | S | S | . | . | . | . | T | . | E | E | . | . | . | F | . | . |
| 35.20.2 | . | . | . | . | . | . | . | . | Y | . | T | E | W | A | S | . | . | . | . | T | . | E | E | . | . | . | F | . | . |
| 35.20.3 | . | . | . | . | . | . | . | . | Y | . | T | E | W | V | S | . | . | . | . | T | . | E | E | . | . | . | F | . | . |
| 35.20.4 | . | . | . | . | . | . | . | . | Y | . | T | E | W | S | S | . | . | . | . | S | . | E | E | . | . | . | F | . | . |

TABLE 14-continued

ADDITIONAL CH3 DOMAIN MODIFICATIONS.

| Clone name | 378 | 379 | 380 | 381 | 382 | 383 | 384 | 385 | 386 | 387 | 388 | 389 | 390 | 391 | 392 | 411 | 412 | 413 | 414 | 415 | 416 | 417 | 418 | 419 | 420 | 421 | 422 | 423 |
|---|---|---|---|---|---|---|---|---|---|---|---|---|---|---|---|---|---|---|---|---|---|---|---|---|---|---|---|---|
| Wild-type | A | V | E | W | E | S | N | G | Q | P | E | N | N | Y | K | T | V | D | K | S | R | W | Q | Q | G | N | V | F |
| 35.20.5 | . | . | . | . | . | . | F | . | T | E | W | A | S | . | . | . | . | T | . | E | E | . | . | . | . | F | . | . |
| 35.20.6 | . | . | . | . | . | . | F | . | T | E | W | V | S | . | . | . | . | T | . | E | E | . | . | . | . | F | . | . |
| 35.21.a.1 | . | . | W | . | . | . | F | . | T | E | W | S | S | . | . | . | . | T | . | E | E | . | . | . | . | F | . | . |
| 35.21.a.2 | . | . | W | . | . | . | Y | . | T | E | W | A | S | . | . | . | . | T | . | E | E | . | . | . | . | F | . | . |
| 35.21.a.3 | . | . | W | . | . | . | Y | . | T | E | W | V | S | . | . | . | . | T | . | E | E | . | . | . | . | F | . | . |
| 35.21.a.4 | . | . | W | . | . | . | Y | . | T | E | W | S | S | . | . | . | . | S | . | E | E | . | . | . | . | F | . | . |
| 35.21.a.5 | . | . | W | . | . | . | F | . | T | E | W | A | S | . | . | . | . | T | . | E | E | . | . | . | . | F | . | . |
| 35.21.a.6 | . | . | W | . | . | . | F | . | T | E | W | V | S | . | . | . | . | T | . | E | E | . | . | . | . | F | . | . |
| 35.23.1 | . | . | . | . | . | . | F | . | T | E | W | S | . | . | . | . | . | T | . | E | E | . | . | . | . | F | . | . |
| 35.23.2 | . | . | . | . | . | . | Y | . | T | E | W | A | . | . | . | . | . | T | . | E | E | . | . | . | . | F | . | . |
| 35.23.3 | . | . | . | . | . | . | Y | . | T | E | W | V | . | . | . | . | . | T | . | E | E | . | . | . | . | F | . | . |
| 35.23.4 | . | . | . | . | . | . | Y | . | T | E | W | S | . | . | . | . | . | S | . | E | E | . | . | . | . | F | . | . |
| 35.23.5 | . | . | . | . | . | . | F | . | T | E | W | A | . | . | . | . | . | T | . | E | E | . | . | . | . | F | . | . |
| 35.23.6 | . | . | . | . | . | . | F | . | T | E | W | V | . | . | . | . | . | T | . | E | E | . | . | . | . | F | . | . |
| 35.24.1 | . | . | W | . | . | . | F | . | T | E | W | S | . | . | . | . | . | T | . | E | E | . | . | . | . | F | . | . |
| 35.24.2 | . | . | W | . | . | . | Y | . | T | E | W | A | . | . | . | . | . | T | . | E | E | . | . | . | . | F | . | . |
| 35.24.3 | . | . | W | . | . | . | Y | . | T | E | W | V | . | . | . | . | . | T | . | E | E | . | . | . | . | F | . | . |
| 35.24.4 | . | . | W | . | . | . | Y | . | T | E | W | S | . | . | . | . | . | S | . | E | E | . | . | . | . | F | . | . |
| 35.24.5 | . | . | W | . | . | . | F | . | T | E | W | A | . | . | . | . | . | T | . | E | E | . | . | . | . | F | . | . |
| 35.24.6 | . | . | W | . | . | . | F | . | T | E | W | V | . | . | . | . | . | T | . | E | E | . | . | . | . | F | . | . |
| 35.21.17.1 | . | . | L | . | . | . | F | . | T | E | W | S | S | . | . | . | . | T | . | E | E | . | . | . | . | F | . | . |
| 35.21.17.2 | . | . | L | . | . | . | Y | . | T | E | W | A | S | . | . | . | . | T | . | E | E | . | . | . | . | F | . | . |
| 35.21.17.3 | . | . | L | . | . | . | Y | . | T | E | W | V | S | . | . | . | . | T | . | E | E | . | . | . | . | F | . | . |
| 35.21.17.4 | . | . | L | . | . | . | Y | . | T | E | W | S | S | . | . | . | . | S | . | E | E | . | . | . | . | F | . | . |
| 35.21.17.5 | . | . | L | . | . | . | F | . | T | E | W | A | S | . | . | . | . | T | . | E | E | . | . | . | . | F | . | . |
| 35.21.17.6 | . | . | L | . | . | . | F | . | T | E | W | V | S | . | . | . | . | T | . | E | E | . | . | . | . | F | . | . |
| 35.20 | . | . | . | . | . | . | Y | . | T | E | W | S | S | . | . | . | . | T | . | E | E | . | . | . | . | F | . | . |
| 35.21 | . | . | W | . | . | . | Y | . | T | E | W | S | S | . | . | . | . | T | . | E | E | . | . | . | . | F | . | . |
| 35.22 | . | . | W | . | . | . | Y | . | T | E | W | S | . | . | . | . | . | T | . | . | E | . | . | . | . | F | . | . |
| 35.23 | . | . | . | . | . | . | Y | . | T | E | W | S | . | . | . | . | . | T | . | E | E | . | . | . | . | F | . | . |
| 35.24 | . | . | W | . | . | . | Y | . | T | E | W | S | . | . | . | . | . | T | . | E | E | . | . | . | . | F | . | . |
| 35.21.17 | . | . | L | . | . | . | Y | . | T | E | W | S | S | . | . | . | . | T | . | E | E | . | . | . | . | F | . | . |
| 35.N390 | . | . | . | . | . | . | Y | . | T | E | W | S | . | . | . | . | . | T | . | . | E | . | . | . | . | F | . | . |
| 35.20.1.1 | | | | | | | F | | T | E | W | S | S | | | | | S | | E | E | | | | | F | | |
| 35.23.2.1 | | | | | | | Y | | T | E | W | A | | | | | | S | | | E | | | | | F | | |
| 35.23.1.1 | | | | | | | F | | T | E | W | S | | | | | | S | | E | E | | | | | F | | |
| 35.S413 | | | | | | | Y | | T | E | W | S | S | | | | | S | | | E | | | | | F | | |

TABLE 14-continued

ADDITIONAL CH3 DOMAIN MODIFICATIONS.

| Clone name | 378 | 379 | 380 | 381 | 382 | 383 | 384 | 385 | 386 | 387 | 388 | 389 | 390 | 391 | 392 | 411 | 412 | 413 | 414 | 415 | 416 | 417 | 418 | 419 | 420 | 421 | 422 | 423 |
|---|---|---|---|---|---|---|---|---|---|---|---|---|---|---|---|---|---|---|---|---|---|---|---|---|---|---|---|---|
| Wild-type | A | V | E | W | E | S | N | G | Q | P | E | N | N | Y | K | T | V | D | K | S | R | W | Q | Q | G | N | V | F |
| 35.23.3.1 |  |  | Y |  |  |  | T |  | E |  | W |  | V |  |  |  |  | S |  |  | E |  | E |  |  |  |  | F |
| 35.N390.1 |  |  | Y |  |  |  | T |  | E |  | W |  | S |  |  |  |  | S |  |  | E |  |  |  |  |  |  | F |
| 35.23.6.1 |  |  | F |  |  |  | T |  | E |  | W |  | V |  |  |  |  | S |  |  | E |  | E |  |  |  |  | F |

INFORMAL SEQUENCE LISTING

| SEQ ID NO | Sequence | Description |
|---|---|---|
| 1 | MAEPRQEFEVMEDHAGTYGLGDRKDQGGYTMHQDQEGDTDAGLKESP LQTPTEDGSEEPGSETSDAKSTPTAEDVTAPLVDEGAPGKQAAAQPHTEIP EGTTAEEAGIGDTPSLEDEAAGHVTQARMVSKSKDGTGSDDKKAKGAD GKTKIATPRGAAPPGQKGQANATRIPAKTPPAPKTPPSSGEPPKSGDRSGY SSPGSPGTPGSRSRTPSLPTPPTREPKKVAVVRTPPKSPSSAKSRLQTAPVP MPDLKNVKSKIGSTENLKHQPGGGKVQIINKKLDLSNVQSKCGSKDNIKH VPGGGSVQIVYKPVDLSKVTSKCGSLGNIHHKPGGGQVEVKSEKLDFKD RVQSKIGSLDNITHVPGGGNKKIETHKLTFRENAKAKTDHGAEIVYKSPV VSGDTSPRHLSNVSSTGSIDMVDSPQLATLADEVSASLAKQGL | full-length human Tau (Tau441; 2N4R) |
| 2 | MGHHHHHHSGEVKPEVKPETHINLKVSDGSSEIFFKIKKTTPLRRLMEAFA KRQGKEMDSLRFLYDGIRIQADQTPEDLDMEDNDIIEAHREQIGGS | His6-Smt3 tag |
| 3 | MGHHHHHHSGEVKPEVKPETHINLKVSDGSSEIFFKIKKTTPLRRLMEAFA KRQGKEMDSLRFLYDGIRIQADQTPEDLDMEDNDIIEAHREQIGGSMAEP RQEFEVMEDHAGTYGLGDRKDQGGYTMHQDQEGDTDAGLKESPLQTPT EDGSEEPGSETSDAKSTPTAEDVTAPLVDEGAPGKQAAAQPHTEIPEGTTA EEAGIGDTPSLEDEAAGHVTQARMVSKSKDGTGSDDKKAKGADGKTKIA TPRGAAPPGQKGQANATRIPAKTPPAPKTPPSSGEPPKSGDRSGYSSPGSP GTPGSRSRTPSLPTPPTREPKKVAVVRTPPKSPSSAKSRLQTAPVPMPDLK NVKSKIGSTENLKHQPGGGKVQIINKKLDLSNVQSKCGSKDNIKHVPGGG SVQIVYKPVDLSKVTSKCGSLGNIHHKPGGGQVEVKSEKLDFKDRVQSKI GSLDNITHVPGGGNKKIETHKLTFRENAKAKTDHGAEIVYKSPVVSGDTS PRHLSNVSSTGSIDMVDSPQLATLADEVSASLAKQGL | Tau441 with His6-Smt3 tag |
| 4 | MAEPRQEFEVMEDHAGTYGLGDRKDQGGYTMHQDQEGDTDAGLKESP LQTPTEDGSEEPGSETSDAKSTPTAEDVTAPLVDEGAPGKQAAAQPHTEIP EGTTAEEAGIGDTPSLEDEAAGHVTQARMVSKSKDGTGSDDKKAKGAD GKTKIATPRGAAPPGQKGQANATRIPAKTPPAPKTPPSSGEPPKSGDRSGY SSPGSPGTPGSRSRTPSLPTPPTREPKKVAVVRTPPKSPSSAKSRLQTAPVP MPDLKNVKSKIGSTENLKHQPGGGKVQIINKKLDLSNVQSKCGSKDNIKH VPGGGSVQIVYKPVDLSKVTSKCGSLGNIHHKPGGGQVEVKSEKLDFKD RVQSKIGSLDNITHVPGGGNKKIETHKLTFRENAKAKTDHGAEIVYKSPV VSGDTSPRHLSNVSSTGSIDMVD | Tau (1-421) |
| 5 | TPTEDGSEEPGSETSDAKSTPTAEDVTAPLVDEGAPGKQAAAQPHTEIPEG TTAEEAGIGDTPSLEDEAAGHVTQARMVSKSKDGTGSDDKKAKGADGK TKIATPRGAAPPGQKGQANATRIPAKTPPAPKTPPSSGEPPKSGDRSGYSSP GSPGTPGSRSRTPSLPTPPTREPKKVAVVRTPPKSPSSAKSRLQTAPVPMPD LKNVKSKIGSTENLKHQPGGGKVQIINKKLDLSNVQSKCGSKDNIKHVPG GGSVQIVYKPVDLSKVTSKCGSLGNIHHKPGGGQVEVKSEKLDFKDRVQ SKIGSLDNITHVPGGGNKKIETHKLTFRENAKAKTDHGAEIVYKSPVVSG DTSPRHLSNVSSTGSIDMVDSPQLATLADEVSASLAKQGL | Tau (50-441) |
| 6 | MADPRQEFDTMEDHAGDYTLLQDQEGDMDHGLKESPPQPPADDGAEEP GSETSDAKSTPTAEDVTAPLVDERAPDKQAAAQPHTEIPEGITAEEAGIGD TPNQEDQAAGHVTQARVASKDRTGNDEKKAKGADGKTGAKIATPRGAA SPAQKGTSNATRIPAKTTPSPKTPPGSGEPPKSGERSGYSSPGSPGTPGSRS RTPSLPTPPTREPKKVAVVRTPPKSPSSAKSRLQTAPVPMPDLKNVRSKIG STENLKHQPGGGKVQIINKKLDLSNVQSKCGSKDNIKHVPGGGSVQIVYK PVDLSKVTSKCGSLGNIHHKPGGGQVEVKSEKLDFKDRVQSKIGSLDNIT HVPGGGNKKIETHKLTFRENAKAKTDHGAEIVYKSPVVSGDTSPRHLSNV SSTGSIDMVDSPQLATLADEVSASLAKQGL | mouse Tau |
| 7 | MAEPRQEFDVMEDHAGTYGLGDRKDQEGYTMLQDQEGDTDAGLKESPL QTPAEDGSEELGSETSDAKSTPTAEDVTAPLVDERAPGEQAAAQPHMEIP EGTTAEEAGIGDTPSLEDEAAGHVTQARMVSKSKDGTGSDDKKAKGAD GKTKIATPRGAAPPGQKGQANATRIPAKTPPAPKTPPSSGEPPKSGDRSGY SSPGSPGTPGSRSRTPSLPTPPAREPKKVAVVRTPPKSPSSAKSRLQTAPVP | cynomolgus Tau |

-continued

INFORMAL SEQUENCE LISTING

| SEQ ID NO | Sequence | Description |
|---|---|---|
|  | MPDLKNVKSKIGSTENLKHQPGGGKVQIINKKLDLSNVQSKCGSKDNIKH VPGGGSVQIVYKPVDLSKVTSKCGSLGNIHHKPGGGQVEVKSEKLDFKD RVQSKIGSLDNITHVPGGGNKKIETHKLTFRENAKAKTDHGAEIVYKSPV VSGDTSPRHLSNVSSTGSIDMVDSPQLATLADEVSASLAKQGL |  |
| 8 | EVQLQQSGAELVRPGASVRLSCTASGFNIKDSLMHWLKQRPEQGLEWIG WIDPEDGETKYAPKFQDKATITADTSSNTAYLQLSSLTSEDTAIYYCTRRD WEGPWGQGTLVTVSA | 1A1 VH |
| 9 | GFNIKDSLMH | 1A1 CDR-H1, 1D10 CDR-H1, 1G7 CDR-H1 |
| 10 | WIDPEDGETKYAPKFQD | 1A1 CDR-H2, 1A5 CDR-H2, 1D10 CDR-H2, 1G7 CDR-H2 |
| 11 | TRRDWEGP | 1A1 CDR-H3 |
| 12 | DIVMTQTPLTLSVTIGQPASISCKSSQSLLYSDGKTYLNWLLQSPGQSPKLL IYLVSKLESGVPDRFSGSGSGTDFTLKISRVEAEDLGVYYCVQGTHFPFTF GSGTKLEIKR | 1A1 VL |
| 13 | KSSQSLLYSDGKTYLN | 1A1 CDR-L1, 1A5 CDR-L1, 1D10 CDR-L1, 1G7 CDR-L1 |
| 14 | LVSKLES | 1A1 CDR-L2, 1A5 CDR-L2, 1D10 CDR-L2, 1G7 CDR-L2 |
| 15 | VQGTHFPFT | 1A1 CDR-L3 |
| 16 | EVQLQQSGAELVRPGASVKLSCTASGFNIKDSLIHWVKQRPEQGLEWIGW IDPEDGETKYAPKFQDKATKTADTSSNTAYLQLSSLTSEDTAIYYCASGE WDYWGQGTSVTVSS | 1A5 VH |
| 17 | GFNIKDSLIH | 1A5 CDR-H1 |
| 18 | ASGEWDY | 1A5 CDR-H3 |
| 19 | DVVMTQTPLTLSVTIGQPASISCKSSQSLLYSDGKTYLNWLLQSPGQSPKL LIYLVSKLESGVPDRFSGSGSGTDFTLKISRVEAEDLGVYYCVQGTHFPYT FGGGTKLELKR | 1A5 VL |
| 20 | VQGTHFPYT | 1A5 CDR-L3, 1D10 CDR-L3, 1G7 CDR-L3 |
| 21 | EVKLVESGGGLVKPGGSLKLSCAASGFTFSSYGMSWVRQTPEKRLEWVA SISGDGGSYIHYADSVKGRFTISRDSAKNTLYLQMSSLRSEDTALYYCARL PYWGQGTLVTVSA | 1C7 VH |
| 22 | GFTFSSYGMS | 1C7 CDR-H1, 1H_G11 CDR-H1, 1H_B12 CDR-H1 |
| 23 | SISGDGGSYIHYADSVK | 1C7 CDR-H2, 1H_G11 CDR-H2, 1H_B12 CDR-H2 |
| 24 | ARLPY | 1C7 CDR-H3, 1H_G11 CDR-H3, 1H_B12 CDR-H3 |

-continued

INFORMAL SEQUENCE LISTING

| SEQ ID NO | Sequence | Description |
|---|---|---|
| 25 | DIVMTQSPSSLTVTAGEKVTMSCKSSQSLLNSGNQKNYLTWYQQKPGQP PKLLIYWASTRESGVPDRFTGSGSGTDFTLTISNVQSEDLAEYFCQQYNSY PLTFGAGTKLELKR | 1C7 VL |
| 26 | KSSQSLLNSGNQKNYLT | 1C7 CDR-L1 |
| 27 | WASTRES | 1C7 CDR-L2 |
| 28 | QQYNSYPLT | 1C7 CDR-L3 |
| 29 | EVQLQQSGAELVRPGASVKLSCTASGFNIKDSLMHWMKQRPEQGLEWIG WIDPEDGETKYAPKFQDKATLTADTSSNAAYLQLSSLTSEDTAIYYCVRG DWDGGYWGQGTTLTVSS | 1D10 VH |
| 30 | VRGDWDGGY | 1D10 CDR-H3 |
| 31 | DVVMTQTPLSLSVTIGQPASISCKSSQSLLYSDGKTYLNWLQQRPGQSPKL LIYLVSKLESGVPDRFSGSGSGTDFTLKISRVEAEDLGVYYCVQGTHFPYT FGGGTKLELKR | 1D10 VL |
| 32 | EVQLQQSGAEVVRPGASVKLSCTTSGFNIKDSLMHWLKQRPEQGLEWIG WIDPEDGETKYAPKFQDKATITADTSSNTAYLQLSSLTSGDTAIYYCARR DWEGPWGQGTLVTVSA | 1G7 VH |
| 33 | ARRDWEGP | 1G7 CDR-H3 |
| 34 | DIVMTQTPLTLSVTIGQPASISCKSSQSLLYSDGKTYLNWLLQSPGQSPKLL IYLVSKLESGVPDRFSGSGSGTDFTLKISRVEAEDLGVYYCVQGTHFPYTF GGGTKLELKR | 1G7 VL |
| 35 | TPSLEDEAAGHVTQA | 1C7 epitope (111-125) |
| 36 | PDLKNVKSKIGSIENLKHQP | 1A1 epitope (251-270) |
| 37 | VKSKIGSTENLKHQP | 1A1 epitope (256-270) |
| 38 | FKDRVQSKIGSLDNI | 1A1 epitope (346-360) |
| 39 | SKIGS | 1A1 epitope |
| 40 | EVKLVESGGGLVKPGGSLKLSCAASGFTFSSYGMSWVRQTPEKRLEWVA SISGDGGSYIHYADSVKGRFTISRDSAKNTLYLQMSSLRSEDTALYYCARL PYWGQGTLVTVSA | 1H_G11 VH, 1H_B12 VH |
| 41 | DIVMTQSQKFMSTSVGDRVSVTCKASQNVGTNVAWYQQKPGQSPKALIY SASYRYSGVPDRFTGSGSGTDFTLTISNVQSEDLAEYFCQQYNTYPLTFGA GTKLELKR | 1H_G11 VL |
| 42 | KASQNVGTNVA | 1H_G11 CDR-L1, 1H_B12 CDR-L1 |
| 43 | SASYRYS | 1H_G11 CDR-L2, 1H_B12 CDR-L2 |
| 44 | QQYNTYPLT | 1H_G11 CDR-L3 |
| 45 | DIVMTQSQKFISTSVGDRVSITCKASQNVGTNVAWYQQKPGQSPKALIYS ASYRYSGVPDRFTGSGSGTDFTLTISNVQSEDLADYFCQQYSSYPLTFGAG TKLEIKR | 1H_B12 VL |
| 46 | QQYSSYPLT | 1H_B12 CDR-L3 |
| 47 | GFNIKDSLxH | 1A1-like CDR-H1 consensus |
| 48 | xRRDWEGP | 1A1-like CDR-H3 consensus |

| | INFORMAL SEQUENCE LISTING | |
|---|---|---|
| SEQ ID NO | Sequence | Description |
| 49 | VQGTHFPxT | 1A1-like CDR-L3 consensus |
| 50 | WASxRxS | 1C7-like CDR-L2 consensus |
| 51 | QQYxxYPLT | 1C7-like CDR-L3 consensus |
| 52 | MAEPRQEFEVMEDHAGTYGLGDRKDQGGYTMHQDQEGDTDAGLKAEE AGIGDTPSLEDEAAGHVTQARMVSKSKDGTGSDDKKAKGADGKTKIATP RGAAPPGQKGQANATRIPAKTPPAPKTPPSSGEPPKSGDRSGYSSPGSPGT PGSRSRTPSLPTPPTREPKKVAVVRTPPKSPSSAKSRLQTAPVPMPDLKNV KSKIGSTENLKHQPGGGKVQIVYKPVDLSKVTSKCGSLGNIHHKPGGGQV EVKSEKLDFKDRVQSKIGSLDNITHVPGGGNKKIETHKLTFRENAKAKTD HGAEIVYKSPVVSGDTSPRHLSNVSSTGSIDMVDSPQLATLADEVSASLAK QGL | human Tau variant 352 (0N3R) |
| 53 | MAEPRQEFEVMEDHAGTYGLGDRKDQGGYTMHQDQEGDTDAGLKESP LQTPTEDGSEEPGSETSDAKSTPTAEAEEAGIGDTPSLEDEAAGHVTQAR MVSKSKDGTGSDDKKAKGADGKTKIATPRGAAPPGQKGQANATRIPAKT PPAPKTPPSSGEPPKSGDRSGYSSPGSPGTPGSRSRTPSLPTPPTREPKKVAV VRTPPKSPSSAKSRLQTAPVPMPDLKNVKSKIGSTENLKHQPGGGKVQIV YKPVDLSKVTSKCGSLGNIHHKPGGGQVEVKSEKLDFKDRVQSKIGSLDN ITHVPGGGNKKIETHKLTFRENAKAKTDHGAEIVYKSPVVSGDTSPRHLS NVSSTGSIDMVDSPQLATLADEVSASLAKQGL | human Tau variant 381 (1N3R) |
| 54 | MAEPRQEFEVMEDHAGTYGLGDRKDQGGYTMHQDQEGDTDAGLKESP LQTPTEDGSEEPGSETSDAKSTPTAEDVTAPLVDEGAPGKQAAAQPHTEIP EGTTAEEAGIGDTPSLEDEAAGHVTQARMVSKSKDGTGSDDKKAKGAD GKTKIATPRGAAPPGQKGQANATRIPAKTPPAPKTPPSSGEPPKSGDRSGY SSPGSPGTPGSRSRTPSLPTPPTREPKKVAVVRTPPKSPSSAKSRLQTAPVP MPDLKNVKSKIGSTENLKHQPGGGKVQIVYKPVDLSKVTSKCGSLGNIHH KPGGGQVEVKSEKLDFKDRVQSKIGSLDNITHVPGGGNKKIETHKLTFRE NAKAKTDHGAEIVYKSPVVSGDTSPRHLSNVSSTGSIDMVDSPQLATLAD EVSASLAKQGL | human Tau variant 410 (2N3R) |
| 55 | MAEPRQEFEVMEDHAGTYGLGDRKDQGGYTMHQDQEGDTDAGLKAEE AGIGDTPSLEDEAAGHVTQARMVSKSKDGTGSDDKKAKGADGKTKIATP RGAAPPGQKGQANATRIPAKTPPAPKTPPSSGEPPKSGDRSGYSSPGSPGT PGSRSRTPSLPTPPTREPKKVAVVRTPPKSPSSAKSRLQTAPVPMPDLKNV KSKIGSTENLKHQPGGGKVQIINKKLDLSNVQSKCGSKDNIKHVPGGGSV QIVYKPVDLSKVTSKCGSLGNIHHKPGGGQVEVKSEKLDFKDRVQSKIGS LDNITHVPGGGNKKIETHKLTFRENAKAKTDHGAEIVYKSPVVSGDTSPR HLSNVSSTGSIDMVDSPQLATLADEVSASLAKQGL | human Tau variant 383 (0N4R) |
| 56 | MAEPRQEFEVMEDHAGTYGLGDRKDQGGYTMHQDQEGDTDAGLKESP LQTPTEDGSEEPGSETSDAKSTPTAEAEEAGIGDTPSLEDEAAGHVTQAR MVSKSKDGTGSDDKKAKGADGKTKIATPRGAAPPGQKGQANATRIPAKT PPAPKTPPSSGEPPKSGDRSGYSSPGSPGTPGSRSRTPSLPTPPTREPKKVAV VRTPPKSPSSAKSRLQTAPVPMPDLKNVKSKIGSTENLKHQPGGGKVQIIN KKLDLSNVQSKCGSKDNIKHVPGGGSVQIVYKPVDLSKVTSKCGSLGNIH HKPGGGQVEVKSEKLDFKDRVQSKIGSLDNITHVPGGGNKKIETHKLTFR ENAKAKTDHGAEIVYKSPVVSGDTSPRHLSNVSSTGSIDMVDSPQLATLA DEVSASLAKQGL | human Tau variant 412 (1N4R) |
| 57-144 | See Table 13 below for sequences | Epitope mapping peptides |
| 145 | EVQLLESGGGLVQPGGSLRLSCAASGFTFSSYGMSWVRQAPGKGLEWVS SISGDGGSYIHYADSVKGRFTISRDNSKNTLYLQMNSLRAEDTAVYYCAR LPYWGQGTLVTVSS | hu1C7.v1 VH |
| 146 | EVQLLESGGGLVQPGGSLRLSCAASGFTFSSYGMSWVRQAPGKGLEWVA SISGDGGSYIHYADSVKGRFTISRDNSKNTLYLQMNSLRAEDTAVYYCAR LPYWGQGTLVTVSS | hu1C7.v2 VH hu1C7.v2-1 VH hu1C7.v2-2 VH |
| 147 | EVQLLESGGGLVQPGGSLRLSCAASGFTFSSYGMSWVRQAPGKGLEWVS SISGDGGSYIHYADSVKGRFTISRDNAKNTLYLQMNSLRAEDTAVYYCAR LPYWGQGTLVTVSS | hu1C7.v3 VH |

| INFORMAL SEQUENCE LISTING | | |
|---|---|---|
| SEQ ID NO | Sequence | Description |
| 148 | EVQLLESGGGLVQPGGSLRLSCAASGFTFSSYGMSWVRQAPGKGLEWVA SISGDGGSYIHYADSVKGRFTISRDNAKNTLYLQMNSLRAEDTAVYYCAR LPYWGQGTLVTVSS | hu1C7.v4 VH |
| 22 | GFTFSSYGMS | hu1C7.v1 CDR-H1, hu1C7.v2 CDR-H1, hu1C7.v3 CDR-H1, hu1C7.v4 CDR-H1, hu1C7.v2-1 CDR-H1, hu1C7.v2-2 CDR-H1 |
| 23 | SISGDGGSYIHYADSVK | hu1C7.v1 CDR-H2, hu1C7.v2 CDR-H2, hu1C7.v3 CDR-H2, hu1C7.v4 CDR-H2, hu1C7.v2-1 CDR-H2, hu1C7.v2-2 CDR-H2 |
| 24 | ARLPY | hu1C7.v1 CDR-H3, hu1C7.v2 CDR-H3, hu1C7.v3 CDR-H3, hu1C7.v4 CDR-H3, hu1C7.v2-1 CDR-H3, hu1C7.v2-2 CDR-H3 |
| 149 | DIVMTQSPDSLAVSLGERATINCKSSQSLLNSGNQKNYLTWYQQKPGQPP KLLIYWASTRESGVPDRFSGSGSGTDFTLTISSLQAEDVAVYYCQQYNSYP LTFGQGTKVEIKR | hu1C7.v1 VL, hu1C7.v2 VL, hu1C7.v3 VL, hu1C7.v4 VL |
| 26 | KSSQSLLNSGNQKNYLT | hu1C7.v1 CDR-L1, hu1C7.v2 CDR-L1, hu1C7.v3 CDR-L1, hu1C7.v4 CDR-L1 |
| 27 | WASTRES | hu1C7.v1 CDR-L2, hu1C7.v2 CDR-L2, hu1C7.v3 CDR-L2, hu1C7.v4 CDR-L2 hu1C7.v2-1 CDR-L2 hu1C7.v2-2 CDR-L2 |
| 28 | QQYNSYPLT | hu1C7.v1 CDR-L3, hu1C7.v2 CDR-L3, hu1C7.v3 CDR-L3, hu1C7.v4 CDR-L3 |
| 150 | GFKFSRVGVS | Affinity matured variant hu1C7.v2 CDR-H1_1 |
| 151 | GFTFSRVGTS | Affinity matured variant hu1C7.v2 CDR-H1_2 |
| 152 | GFRFSRVGMS | Affinity matured variant hu1C7.v2 CDR-H1_3 |
| 153 | GFRFSGPGMS | Affinity matured variant hu1C7.v2 CDR-H1_4 |
| 154 | VIKWRIYGMS | Affinity matured variant hu1C7.v2 CDR-H1_5 |
| 155 | AKLPF | Affinity matured variant hu1C7.v2 CDR-H3_1 |

-continued

| SEQ ID NO | Sequence | Description |
|---|---|---|
| 156 | KSSHSLYSSRRHKHYLA | Affinity matured variant hu1C7.v2 CDR-L1_1 |
| 157 | KSSQSLLRSGKRQNYLV | Affinity matured variant hu1C7.v2 CDR-L1_2 |
| 158 | KSSQSLHRSGTQKDYLV | Affinity matured variant hu1C7.v2 CDR-L1_3 |
| 159 | QKYNSYPLT | Affinity matured variant hu1C7.v2 CDR-L3_1 |
| 160 | QKYDSYPLT | Affinity matured variant hu1C7.v2 CDR-L3_2 |
| 161 | QHYRTYPLT | Affinity matured variant hu1C7.v2 CDR-L3_3 |
| 162 | QHYRSYPMT | Affinity matured variant hu1 C7.v2 CDR-L3_4 |
| 163 | $X_1X_2X_3X_4X_5X_6X_7GX_8S$, wherein $X_1$ is G or V; $X_2$ is F or I; $X_3$ is T, K, or R; $X_4$ is F or W; $X_5$ is S or R; $X_6$ is S, R, G, or I; $X_7$ is Y, V, or P; and $X_8$ is M, V, or T | hu1C7.v2-like CDR-H1 consensus_1 |
| 164 | $AX_1LPX_2$, wherein $X_1$ is R or K; and $X_2$ is Y or F | hu1C7.v2-like CDR-H3 consensus_1 |
| 165 | $KSSX_1SLX_2X_3SX_4X_5X_6X_7X_8YLX_9$, wherein $X_1$ is Q or H; $X_2$ is L, Y, or H; $X_3$ is N, S, or R; $X_4$ is G or R; $X_5$ is N, R, K, or T; $X_6$ is Q, H, or R; $X_7$ is K or Q; $X_8$ is N, H, or D; and $X_9$ is N, T, V | hu1C7.v2-like CDR-L1 consensus_1 |
| 166 | $QX_1YX_2X_3YPX_4T$, wherein $X_1$ is Q, K, or H; $X_2$ is N, D, or R; $X_3$ is S or T; and $X_4$ is L or M | hu1C7.v2-like CDR-L3 consensus_1 |
| 167 | QVQLQQPGAELVGPGSSVKLSCKASGYTFINYWIDWMKQSPGQGLEWIG NIYPSDSESHYNQKFTDKATLTVDISSSTAYLQLSSLTSEDSAVYYCALYS KGYWGQGTSVTVSS | 17G2.A1 VH |
| 168 | GYTFINYWID | 17G2.A1 CDR-H1 |
| 169 | NIYPSDSESHYNQKFTD | 17G2.A1 CDR-H2 |
| 170 | ALYSKGY | 17G2.A1 CDR-H3 |
| 171 | DVLMTQTPLSLPVTLGDQASISCRSSQNIVHTNGNTYLEWYLQKPGQSPK LLIYKLSSRFSGVPDRFSGSGSGTDFTLKISRVEAEDLGVYYCFQGSHLPFT FGGGTKLEIKR | 17G2.A1 VL |
| 172 | RSSQNIVHTNGNTYLE | 17G2.A1 CDR-L1 |
| 173 | KLSSRFS | 17G2.A1 CDR-L2 |
| 174 | FQGSHLPFT | 17G2.A1 CDR-L3 |
| 175 | GXTFINXXID | 17G2.A1-like CDR-H1 consensus |
| 176 | XSSXNIVHTXGNTYLE | 17G2.A1-like CDR-L1 consensus |
| 177 | FXGSHLPXT | 17G2.A1-like CDR-L3 consensus |

| SEQ ID NO | Sequence | Description |
|---|---|---|
| 178 | GEPPKSGDRSGYSSPGSPGT | 17G2.A1 epitope (186-205) |
| 179 | GEPPKSGDRSGYSSP | 17G2.A1 epitope (186-200) |
| 180 | SGDRSGYSSPGSPGT | 17G2.A1 epitope (191-205) |
| 181 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESNGQPENNYKTTPPVLDSDGSFFLYSKLTVDKSRWQQGNVFSCSVMH EALHNHYTQKSLSLSPGK | Wild-type human Fc sequence positions 231-447 EU index numbering |
| 182 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAK | CH2 domain sequence positions 231-340 EU index numbering |
| 183 | GQPREPQVYTLPPSRDELTKNQVSLTCLVKGFYPSDIAVEWESNGQPENN YKTTPPVLDSDGSFFLYSKLTVDKSRWQQGNVFSCSVMHEALHNHYTQK SLSLSPGK | CH3 domain sequence Positions 341-447 EU index numbering |
| 184 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESLGLVWVGYKTTPPVLDSDGSFFLYSKLTVAKSTWQQGWVFSCSVM HEALHNHYTQKSLSLSPGK | Clone CH3C.1 |
| 185 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESYGTVWSHYKTTPPVLDSDGSFFLYSKLTVSKSEWQQGYVFSCSVMH EALHNHYTQKSLSLSPGK | Clone CH3C.2 |
| 186 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESYGTEWSQYKTTPPVLDSDGSFFLYSKLTVEKSDWQQGHVFSCSVMH EALHNHYTQKSLSLSPGK | Clone CH3C.3 |
| 187 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESVGTPWALYKTTPPVLDSDGSFFLYSKLTVLKSEWQQGWVFSCSVMH EALHNHYTQKSLSLSPGK | Clone CH3C.4 |
| 188 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESYGTVWSKYKTTPPVLDSDGSFFLYSKLTVSKSEWQQGFVFSCSVMH EALHNHYTQKSLSLSPGK | Clone CH3C.17 |
| 189 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESLGHVWAVYKTTPPVLDSDGSFFLYSKLTVPKSTWQQGWVFSCSVM HEALHNHYTQKSLSLSPGK | Clone CH3C.18 |
| 190 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESLGLVWVGYKTTPPVLDSDGSFFLYSKLTVPKSTWQQGWVFSCSVM HEALHNHYTQKSLSLSPGK | Clone CH3C.21 |
| 191 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE | Clone CH3C.25 |

INFORMAL SEQUENCE LISTING

| SEQ ID NO | Sequence | Description |
|---|---|---|
| | WESMGHVWVGYKTTPPVLDSDGSFFLYSKLTVDKSTWQQGWVFSCSVM HEALHNHYTQKSLSLSPGK | |
| 192 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESLGLVWVFSKTTPPVLDSDGSFFLYSKLTVPKSTWQQGWVFSCSVMH EALHNHYTQKSLSLSPGK | Clone CH3C.34 |
| 193 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESYGTEWSSYKTTPPVLDSDGSFFLYSKLTVTKSEWQQGFVFSCSVMH EALHNHYTQKSLSLSPGK | Clone CH3C.35 |
| 194 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESYGTEWSNYKTTPPVLDSDGSFFLYSKLTVSKSEWQQGFVFSCSVMH EALHNHYTQKSLSLSPGK | Clone CH3C.44 |
| 195 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESLGHVVWGYKTTPPVLDSDGSFFLYSKLTVSKSEWQQGWVFSCSVM HEALHNHYTQKSLSLSPGK | Clone CH3C.51 |
| 196 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESLGHVWVATKTTPPVLDSDGSFFLYSKLTVPKSTWQQGWVFSCSVM HEALHNHYTQKSLSLSPGK | Clone CH3C.3.1-3 |
| 197 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESLGPVWVHTKTTPPVLDSDGSFFLYSKLTVPKSTWQQGWVFSCSVMH EALHNHYTQKSLSLSPGK | Clone CH3C.3.1-9 |
| 198 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESLGHVWVDQKTTPPVLDSDGSFFLYSKLTVPKSTWQQGWVFSCSVM HEALHNHYTQKSLSLSPGK | Clone CH3C.3.2-5 |
| 199 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESLGHVWVNQKTTPPVLDSDGSFFLYSKLTVPKSTWQQGWVFSCSVM HEALHNHYTQKSLSLSPGK | Clone CH3C.3.2-19 |
| 200 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESLGHVWVNFKTTPPVLDSDGSFFLYSKLTVPKSTWQQGWVFSCSVM HEALHNHYTQKSLSLSPGK | Clone CH3C.3.2-1 |
| 201 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAV WWESLGHVWAVYKTTPPVLDSDGSFFLYSKLTVPKSTWQQGWVFSCSV MHEALHNHYTQKSLSLSPGK | Clone CH3C.18 variant |
| 202 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVL WESLGHVWAVYKTTPPVLDSDGSFFLYSKLTVPKSTWQQGWVFSCSVM HEALHNHYTQKSLSLSPGK | Clone CH3C.18 variant |
| 203 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVY | Clone CH3C.18 variant |

| SEQ ID NO | Sequence | Description |
|---|---|---|
| | WESLGHVWAVYKTTPPVLDSDGSFFLYSKLTVPKSTWQQGWVFSCSVM<br>HEALHNHYTQKSLSLSPGK | |
| 204 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVE<br>WESLGHVWAVYQTTPPVLDSDGSFFLYSKLTVPKSTWQQGWVFSCSVM<br>HEALHNHYTQKSLSLSPGK | Clone CH3C.18 variant |
| 205 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVE<br>WESLGHVWAVYFTTPPVLDSDGSFFLYSKLTVPKSTWQQGWVFSCSVM<br>HEALHNHYTQKSLSLSPGK | Clone CH3C.18 variant |
| 206 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVE<br>WESLGHVWAVYHTTPPVLDSDGSFFLYSKLTVPKSTWQQGWVFSCSVM<br>HEALHNHYTQKSLSLSPGK | Clone CH3C.18 variant |
| 207 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAV<br>WWESLGHVWAVYKTTPPVLDSDGSFFLYSKLTVPKSTWQQGWVFSCSV<br>MHEALHNHYTQKSLSLSPGK | Clone CH3C.35.13 |
| 208 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVE<br>WESLGHVWAVYQTTPPVLDSDGSFFLYSKLTVPKSTWQQGWVFSCSVM<br>HEALHNHYTQKSLSLSPGK | Clone CH3C.35.14 |
| 209 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAV<br>WWESLGHVWAVYQTTPPVLDSDGSFFLYSKLTVPKSTWQQGWVFSCSV<br>MHEALHNHYTQKSLSLSPGK | Clone CH3C.35.15 |
| 210 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAV<br>WWESLGHVWVNQKTTPPVLDSDGSFFLYSKLTVPKSTWQQGWVFSCSV<br>MHEALHNHYTQKSLSLSPGK | Clone CH3C.35.16 |
| 211 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVE<br>WESLGHVWVNQQTTPPVLDSDGSFFLYSKLTVPKSTWQQGWVFSCSVM<br>HEALHNHYTQKSLSLSPGK | Clone CH3C.35.17 |
| 212 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAV<br>WWESLGHVWVNQQTTPPVLDSDGSFFLYSKLTVPKSTWQQGWVFSCSV<br>MHEALHNHYTQKSLSLSPGK | Clone CH3C.35.18 |
| 213 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAV<br>WWESYGTEWSSYKTTPPVLDSDGSFFLYSKLTVTKSEWQQGFVFSCSVM<br>HEALHNHYTQKSLSLSPGK | Clone CH3C.35.19 |
| 214 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVE<br>WESYGTEWSSYKTTPPVLDSDGSFFLYSKLTVTKEEWQQGFVFSCSVMH<br>EALHNHYTQKSLSLSPGK | Clone CH3C.35.20 |
| 215 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAV | Clone CH3C.35.21 |

| SEQ ID NO | Sequence | Description |
|---|---|---|
| | WWESYGTEWSSYKTTPPVLDSDGSFFLYSKLTVTKEEWQQGFVFSCSVM<br>HEALHNHYTQKSLSLSPGK | |
| 216 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAV<br>WWESYGTEWSNYKTTPPVLDSDGSFFLYSKLTVTKSEWQQGFVFSCSVM<br>HEALHNHYTQKSLSLSPGK | Clone CH3C.35.22 |
| 217 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVE<br>WESYGTEWSNYKTTPPVLDSDGSFFLYSKLTVTKEEWQQGFVFSCSVMH<br>EALHNHYTQKSLSLSPGK | Clone CH3C.35.23 |
| 218 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAV<br>WWESYGTEWSNYKTTPPVLDSDGSFFLYSKLTVTKEEWQQGFVFSCSVM<br>HEALHNHYTQKSLSLSPGK | Clone CH3C.35.24 |
| 219 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVE<br>WESYGTEWSNYKTTPPVLDSDGSFFLYSKLTVTKSEWQQGFVFSCSVMH<br>EALHNHYTQKSLSLSPGK | Clone CH3C.35.N163 |
| 220 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVE<br>WESYGTEWSSYQTTPPVLDSDGSFFLYSKLTVTKSEWQQGFVFSCSVMH<br>EALHNHYTQKSLSLSPGK | Clone CH3C.35.K165Q |
| 221 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVE<br>WESYGTEWSNYQTTPPVLDSDGSFFLYSKLTVTKSEWQQGFVFSCSVMH<br>EALHNHYTQKSLSLSPGK | Clone CH3C.35.N163.K165Q |
| 222 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVL<br>WESYGTEWSSYKTTPPVLDSDGSFFLYSKLTVTKSEWQQGFVFSCSVMH<br>EALHNHYTQKSLSLSPGK | Clone CH3C.35.21.1 |
| 223 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVL<br>WESYGTEWSSYRTTPPVLDSDGSFFLYSKLTVTKSEWQQGFVFSCSVMHE<br>ALHNHYTQKSLSLSPGK | Clone CH3C.35.21.2 |
| 224 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVL<br>WESYGTEWSSYRTTPPVLDSDGSFFLYSKLTVTREEWQQGFVFSCSVMHE<br>ALHNHYTQKSLSLSPGK | Clone CH3C.35.21.3 |
| 225 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVL<br>WESYGTEWSSYRTTPPVLDSDGSFFLYSKLTVTGEEWQQGFVFSCSVMH<br>EALHNHYTQKSLSLSPGK | Clone CH3C.35.21.4 |
| 226 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVL<br>WESYGTEWSSYRTTPPVLDSDGSFFLYSKLTVTREEWQQGFVFSCWVMH<br>EALHNHYTQKSLSLSPGK | Clone CH3C.35.21.5 |
| 227 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVL | Clone CH3C.35.21.6 |

| SEQ ID NO | Sequence | Description |
|---|---|---|
| | WESYGTEWSSYRTTPPVLDSDGSFFLYSKLTVTKEEWQQGFVFSCWVMH<br>EALHNHYTQKSLSLSPGK | |
| 228 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVL<br>WESYGTEWSSYRTTPPVLDSDGSFFLYSKLTVTREEWQQGFVFTCWVMH<br>EALHNHYTQKSLSLSPGK | Clone CH3C.35.21.7 |
| 229 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVL<br>WESYGTEWSSYRTTPPVLDSDGSFFLYSKLTVTREEWQQGFVFTCGVMH<br>EALHNHYTQKSLSLSPGK | Clone CH3C.35.21.8 |
| 230 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVL<br>WESYGTEWSSYRTTPPVLDSDGSFFLYSKLTVTREEWQQGFVFECWVMH<br>EALHNHYTQKSLSLSPGK | Clone CH3C.35.21.9 |
| 231 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVL<br>WESYGTEWSSYRTTPPVLDSDGSFFLYSKLTVTREEWQQGFVFKCWVMH<br>EALHNHYTQKSLSLSPGK | Clone CH3C.35.21.10 |
| 232 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVL<br>WESYGTEWSSYRTTPPVLDSDGSFFLYSKLTVTPEEWQQGFVFKCWVMH<br>EALHNHYTQKSLSLSPGK | Clone CH3C.35.21.11 |
| 233 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAV<br>WWESYGTEWSSYRTTPPVLDSDGSFFLYSKLTVTREEWQQGFVFSCSVM<br>HEALHNHYTQKSLSLSPGK | Clone CH3C.35.21.12 |
| 234 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAV<br>WWESYGTEWSSYRTTPPVLDSDGSFFLYSKLTVTGEEWQQGFVFSCSVM<br>HEALHNHYTQKSLSLSPGK | Clone CH3C.35.21.13 |
| 235 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAV<br>WWESYGTEWSSYRTTPPVLDSDGSFFLYSKLTVTREEWQQGFVFTCWV<br>MHEALHNHYTQKSLSLSPGK | Clone CH3C.35.21.14 |
| 236 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAV<br>WWESYGTEWSSYRTTPPVLDSDGSFFLYSKLTVTGEEWQQGFVFTCWV<br>MHEALHNHYTQKSLSLSPGK | Clone CH3C.35.21.15 |
| 237 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAV<br>WWESYGTEWSSYRTTPPVLDSDGSFFLYSKLTVTREEWQQGFVFTCGVM<br>HEALHNHYTQKSLSLSPGK | Clone CH3C.35.21.16 |
| 238 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVL<br>WESYGTEWSSYKTTPPVLDSDGSFFLYSKLTVTKEEWQQGFVFSCSVMH<br>EALHNHYTQKSLSLSPGK | Clone CH3C.35.21.17 |
| 239 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVL | Clone CH3C.35.21.18 |

| | INFORMAL SEQUENCE LISTING | |
|---|---|---|
| SEQ ID NO | Sequence | Description |
| | WESYGTEWSSYRTTPPVLDSDGSFFLYSKLTVTKEEWQQGFVFSCSVMH EALHNHYTQKSLSLSPGK | |
| 240 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESFGTEWSSYKTTPPVLDSDGSFFLYSKLTVTKEEWQQGFVFSCSVMHE ALHNHYTQKSLSLSPGK | Clone CH3C.35.20.1 |
| 241 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESYGTEWASYKTTPPVLDSDGSFFLYSKLTVTKEEWQQGFVFSCSVMH EALHNHYTQKSLSLSPGK | Clone CH3C.35.20.2 |
| 242 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESYGTEWVSYKTTPPVLDSDGSFFLYSKLTVTKEEWQQGFVFSCSVMH EALHNHYTQKSLSLSPGK | Clone CH3C.35.20.3 |
| 243 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESYGTEWSSYKTTPPVLDSDGSFFLYSKLTVSKEEWQQGFVFSCSVMH EALHNHYTQKSLSLSPGK | Clone CH3C.35.20.4 |
| 244 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESFGTEWASYKTTPPVLDSDGSFFLYSKLTVTKEEWQQGFVFSCSVMH EALHNHYTQKSLSLSPGK | Clone CH3C.35.20.5 |
| 245 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESFGTEWVSYKTTPPVLDSDGSFFLYSKLTVTKEEWQQGFVFSCSVMH EALHNHYTQKSLSLSPGK | Clone CH3C.35.20.6 |
| 246 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAV WWESFGTEWSSYKTTPPVLDSDGSFFLYSKLTVTKEEWQQGFVFSCSVM HEALHNHYTQKSLSLSPGK | Clone CH3C.35.21.a.1 |
| 247 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAV WWESYGTEWASYKTTPPVLDSDGSFFLYSKLTVTKEEWQQGFVFSCSVM HEALHNHYTQKSLSLSPGK | Clone CH3C.35.21.a.2 |
| 248 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAV WWESYGTEWVSYKTTPPVLDSDGSFFLYSKLTVTKEEWQQGFVFSCSVM HEALHNHYTQKSLSLSPGK | Clone CH3C.35.21.a.3 |
| 249 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAV WWESYGTEWSSYKTTPPVLDSDGSFFLYSKLTVSKEEWQQGFVFSCSVM HEALHNHYTQKSLSLSPGK | Clone CH3C.35.21.a.4 |
| 250 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAV WWESFGTEWASYKTTPPVLDSDGSFFLYSKLTVTKEEWQQGFVFSCSVM HEALHNHYTQKSLSLSPGK | Clone CH3C.35.21.a.5 |
| 251 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAV | Clone CH3C.35.21.a.6 |

INFORMAL SEQUENCE LISTING

| SEQ ID NO | Sequence | Description |
|---|---|---|
| | WWESFGTEWVSYKTTPPVLDSDGSFFLYSKLTVTKEEWQQGFVFSCSVM<br>HEALHNHYTQKSLSLSPGK | |
| 252 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVE<br>WESFGTEWSNYKTTPPVLDSDGSFFLYSKLTVTKEEWQQGFVFSCSVMH<br>EALHNHYTQKSLSLSPGK | Clone CH3C.35.23.1 |
| 253 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVE<br>WESYGTEWANYKTTPPVLDSDGSFFLYSKLTVTKEEWQQGFVFSCSVMH<br>EALHNHYTQKSLSLSPGK | Clone CH3C.35.23.2 |
| 254 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVE<br>WESYGTEWVNYKTTPPVLDSDGSFFLYSKLTVTKEEWQQGFVFSCSVMH<br>EALHNHYTQKSLSLSPGK | Clone CH3C.35.23.3 |
| 255 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVE<br>WESYGTEWSNYKTTPPVLDSDGSFFLYSKLTVSKEEWQQGFVFSCSVMH<br>EALHNHYTQKSLSLSPGK | Clone CH3C.35.23.4 |
| 256 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVE<br>WESFGTEWANYKTTPPVLDSDGSFFLYSKLTVTKEEWQQGFVFSCSVMH<br>EALHNHYTQKSLSLSPGK | Clone CH3C.35.23.5 |
| 257 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAVE<br>WESFGTEWVNYKTTPPVLDSDGSFFLYSKLTVTKEEWQQGFVFSCSVMH<br>EALHNHYTQKSLSLSPGK | Clone CH3C.35.23.6 |
| 258 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAV<br>WWESFGTEWSNYKTTPPVLDSDGSFFLYSKLTVTKEEWQQGFVFSCSVM<br>HEALHNHYTQKSLSLSPGK | Clone CH3C.35.24.1 |
| 259 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAV<br>WWESYGTEWANYKTTPPVLDSDGSFFLYSKLTVTKEEWQQGFVFSCSV<br>MHEALHNHYTQKSLSLSPGK | Clone CH3C.35.24.2 |
| 260 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAV<br>WWESYGTEWVNYKTTPPVLDSDGSFFLYSKLTVTKEEWQQGFVFSCSV<br>MHEALHNHYTQKSLSLSPGK | Clone CH3C.35.24.3 |
| 261 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAV<br>WWESYGTEWSNYKTTPPVLDSDGSFFLYSKLTVSKEEWQQGFVFSCSVM<br>HEALHNHYTQKSLSLSPGK | Clone CH3C.35.24.4 |
| 262 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAV<br>WWESFGTEWANYKTTPPVLDSDGSFFLYSKLTVTKEEWQQGFVFSCSVM<br>HEALHNHYTQKSLSLSPGK | Clone CH3C.35.24.5 |
| 263 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLTCLVKGFYPSDIAV | Clone CH3C.35.24.6 |

| | INFORMAL SEQUENCE LISTING | |
|---|---|---|
| SEQ ID NO | Sequence | Description |
| | WWESFGTEWVNYKTTPPVLDSDGSFFLYSKLTVTKEEWQQGFVFSCSVM HEALHNHYTQKSLSLSPGK | |
| 264 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVL WESFGTEWSSYKTTPPVLDSDGSFFLYSKLTVTKEEWQQGFVFSCSVMHE ALHNHYTQKSLSLSPGK | Clone CH3C.35.21.17.1 |
| 265 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVL WESYGTEWASYKTTPPVLDSDGSFFLYSKLTVTKEEWQQGFVFSCSVMH EALHNHYTQKSLSLSPGK | Clone CH3C.35.21.17.2 |
| 266 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVL WESYGTEWVSYKTTPPVLDSDGSFFLYSKLTVTKEEWQQGFVFSCSVMH EALHNHYTQKSLSLSPGK | Clone CH3C.35.21.17.3 |
| 267 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVL WESYGTEWSSYKTTPPVLDSDGSFFLYSKLTVSKEEWQQGFVFSCSVMH EALHNHYTQKSLSLSPGK | Clone CH3C.35.21.17.4 |
| 268 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVL WESFGTEWASYKTTPPVLDSDGSFFLYSKLTVTKEEWQQGFVFSCSVMH EALHNHYTQKSLSLSPGK | Clone CH3C.35.21.17.5 |
| 269 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVL WESFGTEWSYKTTPPVLDSDGSFFLYSKLTVTKEEWQQGFVFSCSVMH EALHNHYTQKSLSLSPGK | Clone CH3C.35.21.17.6 |
| 270 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESYGTEWSNYKTTPPVLDSDGSFFLYSKLTVTKSEWQQGFVFSCSVMH EALHNHYTQKSLSLSPGK | Clone CH3C.35.N390 |
| 271 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV WWESYGTEWSSYKTTPPVLDSDGSFFLYSKLTVTKEEWQQGFVFSCSVM HEALHNHYTQKSLSLSPGK | Clone CH3C.35.21 with knob mutation |
| 272 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV WWESYGTEWSSYKTTPPVLDSDGSFFLYSKLTVTKEEWQQGFVFSCSVM HEALHNHYTQKSLSLSPGK | Clone CH3C.35.21 with knob and LALA mutations |
| 273 | APELLGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV WWESYGTEWSSYKTTPPVLDSDGSFFLYSKLTVTKEEWQQGFVFSCSVM HEALHNHYTQKSLSLSPGK | Clone CH3C.35.21 with knob and YTE mutations |
| 274 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV WWESYGTEWSSYKTTPPVLDSDGSFFLYSKLTVTKEEWQQGFVFSCSVM HEALHNHYTQKSLSLSPGK | Clone CH3C.35.21 with knob, LALA, and YTE mutations |
| 275 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL | Clone CH3C.35.21 |

| SEQ ID NO | Sequence | Description |
|---|---|---|
| | PAPIEKTISKAKGQPREPQVYTLPPSRDELTKNQVSLSCAVKGFYPSDIAV WWESYGTEWSSYKTTPPVLDSDGSFFLVSKLTVTKEEWQQGFVFSCSVM HEALHNHYTQKSLSLSPGK | with hole mutations |
| 276 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAV WWESYGTEWSSYKTTPPVLDSDGSFFLVSKLTVTKEEWQQGFVFSCSVM HEALHNHYTQKSLSLSPGK | Clone CH3C.35.21 with hole and LALA mutations |
| 277 | APELLGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAV WWESYGTEWSSYKTTPPVLDSDGSFFLVSKLTVTKEEWQQGFVFSCSVM HEALHNHYTQKSLSLSPGK | Clone CH3C.35.21 with hole and YTE mutations |
| 278 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAV WWESYGTEWSSYKTTPPVLDSDGSFFLVSKLTVTKEEWQQGFVFSCSVM HEALHNHYTQKSLSLSPGK | Clone CH3C.35.21 with hole, LALA, and YTE mutations |
| 279 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESNGQPENNYKTTPPVLDSDGSFFLVSKLTVDKSRWQQGNVFSCSVMH EALHNHYTQKSLSLSPGK | Fc sequence with hole mutations |
| 280 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESNGQPENNYKTTPPVLDSDGSFFLVSKLTVDKSRWQQGNVFSCSVMH EALHNHYTQKSLSLSPGK | Fc sequence with hole and LALA mutations |
| 281 | APELLGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESNGQPENNYKTTPPVLDSDGSFFLVSKLTVDKSRWQQGNVFSCSVMH EALHNHYTQKSLSLSPGK | Fc sequence with hole and YTE mutations |
| 282 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESNGQPENNYKTTPPVLDSDGSFFLVSKLTVDKSRWQQGNVFSCSVMH EALHNHYTQKSLSLSPGK | Fc sequence withhole, LALA, and YTE mutations |
| 283 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESNGQPENNYKTTPPVLDSDGSFFLYSKLTVDKSRWQQGNVFSCSVM HEALHNHYTQKSLSLSPGK | Fc sequence with knob mutation |
| 284 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESNGQPENNYKTTPPVLDSDGSFFLYSKLTVDKSRWQQGNVFSCSVM HEALHNHYTQKSLSLSPGK | Fc sequence with knob and LALA mutations |
| 285 | APELLGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESNGQPENNYKTTPPVLDSDGSFFLYSKLTVDKSRWQQGNVFSCSVM HEALHNHYTQKSLSLSPGK | Fc sequence with knob and YTE mutations |
| 286 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESNGQPENNYKTTPPVLDSDGSFFLYSKLTVDKSRWQQGNVFSCSVM HEALHNHYTQKSLSLSPGK | Fc sequence with knob, LALA, and YTE mutations |
| 287 | EPKSCDKTHTCPPCP | Human IgG1 hinge amino acid sequence |

| SEQ ID NO | Sequence | Description |
|---|---|---|
| 288 | MMDQARSAFSNLFGGEPLSYTRFSLARQVDGDNSHVEMKLAVDEEENA<br>DNNTKANVTKPKRCSGSICYGTIAVIVFFLIGFMIGYLGYCKGVEPKTECE<br>RLAGTESPVREEPGEDFPAARRLYWDDLKRKLSEKLDSTDFTGTIKLLNE<br>NSYVPREAGSQKDENLALYVENQFREFKLSKVWRDQHFVKIQVKDSAQN<br>SVIIVDKNGRLVYLVENPGGYVAYSKAATVTGKLVHANFGTKKDFEDLY<br>TPVNGSIVIVRAGKITFAEKVANAESLNAIGVLIYMDQTKFPIVNAELSFFG<br>HAHLGTGDPYTPGFPSFNHTQFPPSRSSGLPNIPVQTISRAAAEKLFGNME<br>GDCPSDWKTDSTCRMVTSESKNVKLTVSNVLKEIKILNIFGVIKGFVEPDH<br>YVVVGAQRDAWGPGAAKSGVGTALLLKLAQMFSDMVLKDGFQPSRSIIF<br>ASWSAGDFGSVGATEWLEGYLSSLHLKAFTYINLDKAVLGTSNFKVSASP<br>LLYTLIEKTMQNVKHPVTGQFLYQDSNWASKVEKLTLDNAAFPFLAYSGI<br>PAVSFCFCEDTDYPYLGTTMDTYKELIERIPELNKVARAAAEVAGQFVIKL<br>THDVELNLDYERYNSQLLSFVRDLNQYRADIKEMGLSLQWLYSARGDFF<br>RATSRLTTDFGNAEKTDRFVMKKLNDRVMRVEYHFLSPYVSPKESPFRH<br>VFWGSGSHTLPALLENLKLRKQNNGAFNETLFRNQLALATWTIQGAANA<br>LSGDVWDIDNEF | Human transferrin receptor protein 1 (TFR1) |
| 289 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPRFDYVTTLPPSRDELTKNQVSLTCLVKGFYPSDIAVE<br>WESNGQPENNYKTTPPVLDSDGSFFLYSKLTVDKSRWQQGNVFSCSVMH<br>EALHNHYGFHDLSLSPGK | Clone CH3B.1 |
| 290 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPRFDMVTTLPPSRDELTKNQVSLTCLVKGFYPSDIAV<br>EWESNGQPENNYKTTPPVLDSDGSFFLYSKLTVDKSRWQQGNVFSCSVM<br>HEALHNHYGFHDLSLSPGK | Clone CH3B.2 |
| 291 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPRFEYVTTLPPSRDELTKNQVSLTCLVKGFYPSDIAVE<br>WESNGQPENNYKTTPPVLDSDGSFFLYSKLTVDKSRWQQGNVFSCSVMH<br>EALHNHYGFHDLSLSPGK | Clone CH3B.3 |
| 292 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPRFEMVTTLPPSRDELTKNQVSLTCLVKGFYPSDIAVE<br>WESNGQPENNYKTTPPVLDSDGSFFLYSKLTVDKSRWQQGNVFSCSVMH<br>EALHNHYGFHDLSLSPGK | Clone CH3B.4 |
| 293 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPRFELVTTLPPSRDELTKNQVSLTCLVKGFYPSDIAVE<br>WESNGQPENNYKTTPPVLDSDGSFFLYSKLTVDKSRWQQGNVFSCSVMH<br>EALHNHYGFHDLSLSPGK | Clone CH3B.5 |
| 294 | APELLGGPSVFLFPPKPKDTLMISRTPEVTCVVVDVSHEDPEVFIWYVDG<br>VDVRYEWQLPREEQYNSTYRVVSVLTVLHQDWLNGKEYKCKVSNKALP<br>APIEKTISKAKGQPREPQVYTLPPSRDELTKNQVSLTCLVKGFYPSDIAVE<br>WESNGQPENNYKTTPPVLDSDGSFFLYSKLTVDKSRWQQGNVFSCSVMH<br>EALHNHYTQKSLSLSPGK | Clone CH2A2.1 |
| 295 | APELLGGPSVFLFPPKPKDTLMISRTPEVTCVVVDVSHEDPEVGFVWYVD<br>GVPVSWEWYWPREEQYNSTYRVVSVLTVLHQDWLNGKEYKCKVSNKA<br>LPAPIEKTISKAKGQPREPQVYTLPPSRDELTKNQVSLTCLVKGFYPSDIAV<br>EWESNGQPENNYKTTPPVLDSDGSFFLYSKLTVDKSRWQQGNVFSCSVM<br>HEALHNHYTQKSLSLSPGK | Clone CH2A2.2 |
| 296 | APELLGGPSVFLFPPKPKDTLMISRTPEVTCVVVDVSHEDPEVQFDWYVD<br>GVMVRREWHRPREEQYNSTYRVVSVLTVLHQDWLNGKEYKCKVSNKA<br>LPAPIEKTISKAKGQPREPQVYTLPPSRDELTKNQVSLTCLVKGFYPSDIAV<br>EWESNGQPENNYKTTPPVLDSDGSFFLYSKLTVDKSRWQQGNVFSCSVM<br>HEALHNHYTQKSLSLSPGK | Clone CH2A2.3 |
| 297 | APELLGGPSVFLFPPKPKDTLMISRTPEVTCVVVDVSHEDPEVSFEWYVD<br>GVPVRWEWQWPREEQYNSTYRVVSVLTVLHQDWLNGKEYKCKVSNKA<br>LPAPIEKTISKAKGQPREPQVYTLPPSRDELTKNQVSLTCLVKGFYPSDIAV<br>EWESNGQPENNYKTTPPVLDSDGSFFLYSKLTVDKSRWQQGNVFSCSVM<br>HEALHNHYTQKSLSLSPGK | Clone CH2A2.4 |

| SEQ ID NO | Sequence | Description |
|---|---|---|
| 298 | APELLGGPSVFLFPPKPKDTLMISRTPEVTCVVVDVSHEDPEVAFTWYVD GVPVRWEWQNPREEQYNSTYRVVSVLTVLHQDWLNGKEYKCKVSNKA LPAPIEKTISKAKGQPREPQVYTLPPSRDELTKNQVSLTCLVKGFYPSDIAV EWESNGQPENNYKTTPPVLDSDGSFFLYSKLTVDKSRWQQGNVFSCSVM HEALHNHYTQKSLSLSPGK | Clone CH2A2.5 |
| 299 | APELLGGPSVFLFPPKPKDTLMISRTPEVTCVVVDPQTPPWEVKFNWYVD GVEVHNAKTKPREEEYYTYYRVVSVLTVLHQDWLNGKEYKCKVSNKAL PAPIEKTISKAKGQPREPQVYTLPPSRDELTKNQVSLTCLVKGFYPSDIAVE WESNGQPENNYKTTPPVLDSDGSFFLYSKLTVDKSRWQQGNVFSCSVMH EALHNHYTQKSLSLSPGK | Clone CH2C.1 |
| 300 | APELLGGPSVFLFPPKPKDTLMISRTPEVTCVVVDPPSPPWEVKFNWYVD GVEVHNAKTKPREEEYYSNYRVVSVLTVLHQDWLNGKEYKCKVSNKAL PAPIEKTISKAKGQPREPQVYTLPPSRDELTKNQVSLTCLVKGFYPSDIAVE WESNGQPENNYKTTPPVLDSDGSFFLYSKLTVDKSRWQQGNVFSCSVMH EALHNHYTQKSLSLSPGK | Clone CH2C.2 |
| 301 | APELLGGPSVFLFPPKPKDTLMISRTPEVTCVVVDPQTPPWEVKFNWYVD GVEVHNAKTKPREEEYYSNYRVVSVLTVLHQDWLNGKEYKCKVSNKAL PAPIEKTISKAKGQPREPQVYTLPPSRDELTKNQVSLTCLVKGFYPSDIAVE WESNGQPENNYKTTPPVLDSDGSFFLYSKLTVDKSRWQQGNVFSCSVMH EALHNHYTQKSLSLSPGK | Clone CH2C.3 |
| 302 | APELLGGPSVFLFPPKPKDTLMISRTPEVTCVVVDFRGPPWEVKFNWYVD GVEVHNAKTKPREEEYYHDYRVVSVLTVLHQDWLNGKEYKCKVSNKAL PAPIEKTISKAKGQPREPQVYTLPPSRDELTKNQVSLTCLVKGFYPSDIAVE WESNGQPENNYKTTPPVLDSDGSFFLYSKLTVDKSRWQQGNVFSCSVMH EALHNHYTQKSLSLSPGK | Clone CH2C.4 |
| 303 | APELLGGPSVFLFPPKPKDTLMISRTPEVTCVVVDPQTVPWEVKFNWYVD GVEVHNAKTKPREEEYYSNYRVVSVLTVLHQDWLNGKEYKCKVSNKAL PAPIEKTISKAKGQPREPQVYTLPPSRDELTKNQVSLTCLVKGFYPSDIAVE WESNGQPENNYKTTPPVLDSDGSFFLYSKLTVDKSRWQQGNVFSCSVMH EALHNHYTQKSLSLSPGK | Clone CH2C.5 |
| 304 | APELLGGPSVFLFPPKPKDTLMISRTPEVTCVVVDVSVPPRMVKFNWYVD GVEVHNAKTKSLTSQHNSTVRVVSVLTVLHQDWLNGKEYKCKVSNKAL PAPIEKTISKAKGQPREPQVYTLPPSRDELTKNQVSLTCLVKGFYPSDIAVE WESNGQPENNYKTTPPVLDSDGSFFLYSKLTVDKSRWQQGNVFSCSVMH EALHNHYTQKSLSLSPGK | Clone CH2D.1 |
| 305 | APELLGGPSVFLFPPKPKDTLMISRTPEVTCVVVDVSVPPWMVKFNWYV DGVEVHNAKTKSLTSQHNSTVRVVSVLTVLHQDWLNGKEYKCKVSNKA LPAPIEKTISKAKGQPREPQVYTLPPSRDELTKNQVSLTCLVKGFYPSDIAV EWESNGQPENNYKTTPPVLDSDGSFFLYSKLTVDKSRWQQGNVFSCSVM HEALHNHYTQKSLSLSPGK | Clone CH2D.2 |
| 306 | APELLGGPSVFLFPPKPKDTLMISRTPEVTCVVVDVSDMWEYVKFNWYV DGVEVHNAKTKPWVKQLNSTWRVVSVLTVLHQDWLNGKEYKCKVSNK ALPAPIEKTISKAKGQPREPQVYTLPPSRDELTKNQVSLTCLVKGFYPSDIA VEWESNGQPENNYKTTPPVLDSDGSFFLYSKLTVDKSRWQQGNVFSCSV MHEALHNHYTQKSLSLSPGK | Clone CH2D.3 |
| 307 | APELLGGPSVFLFPPKPKDTLMISRTPEVTCVVVDVSDDWTWVKFNWYV DGVEVHNAKTKPWIAQPNSTWRVVSVLTVLHQDWLNGKEYKCKVSNK ALPAPIEKTISKAKGQPREPQVYTLPPSRDELTKNQVSLTCLVKGFYPSDIA VEWESNGQPENNYKTTPPVLDSDGSFFLYSKLTVDKSRWQQGNVFSCSV MHEALHNHYTQKSLSLSPGK | Clone CH2D.4 |
| 308 | APELLGGPSVFLFPPKPKDTLMISRTPEVTCVVVDVSDDWEWVKFNWYV DGVEVHNAKTKPWKLQLNSTWRVVSVLTVLHQDWLNGKEYKCKVSNK ALPAPIEKTISKAKGQPREPQVYTLPPSRDELTKNQVSLTCLVKGFYPSDIA VEWESNGQPENNYKTTPPVLDSDGSFFLYSKLTVDKSRWQQGNVFSCSV MHEALHNHYTQKSLSLSPGK | Clone CH2D.5 |
| 309 | APELLGGPSVFLFPPKPKDTLMISRTPEVTCVVVDVSHEDPWVWFYWYV DGVEVHNAKTKPREEQYNSTYRVVSVLTVLHQDWLNGKEYKCSVVNIA LWWSIEKTISKAKGQPREPQVYTLPPSRDELTKNQVSLTCLVKGFYPSDIA VEWESNGQPENNYKTTPPVLDSDGSFFLYSKLTVDKSRWQQGNVFSCSV MHEALHNHYTQKSLSLSPGK | Clone CH2E3.1 |

| INFORMAL SEQUENCE LISTING | | |
|---|---|---|
| SEQ ID NO | Sequence | Description |
| 310 | APELLGGPSVFLFPPKPKDTLMISRTPEVTCVVVDVSHEDPVVGFRWYVD GVEVHNAKTKPREEQYNSTYRVVSVLTVLHQDWLNGKEYKCRVSNSAL TWKIEKTISKAKGQPREPQVYTLPPSRDELTKNQVSLTCLVKGFYPSDIAV EWESNGQPENNYKTTPPVLDSDGSFFLYSKLTVDKSRWQQGNVFSCSVM HEALHNHYTQKSLSLSPGK | Clone CH2E3.2 |
| 311 | APELLGGPSVFLFPPKPKDTLMISRTPEVTCVVVDVSHEDPVVGFRWYVD GVEVHNAKTKPREEQYNSTYRVVSVLTVLHQDWLNGKEYKCRVSNSAL SWRIEKTISKAKGQPREPQVYTLPPSRDELTKNQVSLTCLVKGFYPSDIAV EWESNGQPENNYKTTPPVLDSDGSFFLYSKLTVDKSRWQQGNVFSCSVM HEALHNHYTQKSLSLSPGK | Clone CH2E3.3 |
| 312 | APELLGGPSVFLFPPKPKDTLMISRTPEVTCVVVDVSHEDPIVGFRWYVDG VEVHNAKTKPREEQYNSTYRVVSVLTVLHQDWLNGKEYKCRVSNSALR WRIEKTISKAKGQPREPQVYTLPPSRDELTKNQVSLTCLVKGFYPSDIAVE WESNGQPENNYKTTPPVLDSDGSFFLYSKLTVDKSRWQQGNVFSCSVMH EALHNHYTQKSLSLSPGK | Clone CH2E3.4 |
| 313 | APELLGGPSVFLFPPKPKDTLMISRTPEVTCVVVDVSHEDPAVGFEWYVD GVEVHNAKTKPREEQYNSTYRVVSVLTVLHQDWLNGKEYKCQVFNWA LDWVIEKTISKAKGQPREPQVYTLPPSRDELTKNQVSLTCLVKGFYPSDIA VEWESNGQPENNYKTTPPVLDSDGSFFLYSKLTVDKSRWQQGNVFSCSV MHEALHNHYTQKSLSLSPGK | Clone CH2E3.5 |
| 314 | EVKLVESGGGLVKPGGSLKLSCAASGFTFSSYGMSWVRQTPEKRLEWVA SISGDGGSYIHYADSVKGRFTISRDSAKNTLYLQMSSLRSEDTALYYCARL PYWGQGTLVTVSAASTKGPSVFPLAPSSKSTSGGTAALGCLVKDYFPEPV TVSWNSGALTSGVHTFPAVLQSSGLYSLSSVVTVPSSSLGTQTYICNVNH KPSNTKVDKKVEPKSCDKTH | 1C7 VH + CH1 sequence |
| 315 | DIVMTQSPSSLTVTAGEKVTMSCKSSQSLLNSGNQKNYLTWYQQKPGQP PKLLIYWASTRESGVPDRFTGSGSGTDFTLTISNVQSEDLAEYFCQQYNSY PLTFGAGTKLELKRTVAAPSVFIFPPSDEQLKSGTASVVCLLNNFYPREAK VQWKVDNALQSGNSQESVTEQDSKDSTYSLSSTLTLSKADYEKHKVYAC EVTHQGLSSPVTKSFNRGEC | ch1C7.LC |
| 316 | EVKLVESGGGLVKPGGSLKLSCAASGFTFSSYGMSWVRQTPEKRLEWVA SISGDGGSYIHYADSVKGRFTISRDSAKNTLYLQMSSLRSEDTALYYCARL PYWGQGTLVTVSAASTKGPSVFPLAPSSKSTSGGTAALGCLVKDYFPEPV TVSWNSGALTSGVHTFPAVLQSSGLYSLSSVVTVPSSSLGTQTYICNVNH KPSNTKVDKKVEPKSCDKTHTCPPCPAPEAAGGPSVFLFPPKPKDTLMISR TPEVTCVVVDVSHEDPEVKFNWYVDGVEVHNAKTKPREEQYNSTYRVV SVLTVLHQDWLNGKEYKCKVSNKALGAPIEKTISKAKGQPREPQVYTLPP SRDELTKNQVSLSCAVKGFYPSDIAVEWESNGQPENNYKTTPPVLDSDGS FFLVSKLTVDKSRWQQGNVFSCSVMHEALHNHYTQKSLSLSPGK | ch1C7.HC.LALAPG. hole |
| 317 | EVKLVESGGGLVKPGGSLKLSCAASGFTFSSYGMSWVRQTPEKRLEWVA SISGDGGSYIHYADSVKGRFTISRDSAKNTLYLQMSSLRSEDTALYYCARL PYWGQGTLVTVSAASTKGPSVFPLAPSSKSTSGGTAALGCLVKDYFPEPV TVSWNSGALTSGVHTFPAVLQSSGLYSLSSVVTVPSSSLGTQTYICNVNH KPSNTKVDKKVEPKSCDKTHTCPPCPAPEAAGGPSVFLFPPKPKDTLMISR TPEVTCVVVDVSHEDPEVKFNWYVDGVEVHNAKTKPREEQYNSTYRVV SVLTVLHQDWLNGKEYKCKVSNKALGAPIEKTISKAKGQPREPQVYTLPP SRDELTKNQVSLWCLVKGFYPSDIAVWWESYGTEWSSYKTTPPVLDSDG SFFLYSKLTVTKEEWQQGFVFSCSVMHEALHNHYTQKSLSLSPGK | ch1C7.HC.CH3C.35. 21.LALAPG.knob |
| 318 | EVKLVESGGGLVKPGGSLKLSCAASGFTFSSYGMSWVRQTPEKRLEWVA SISGDGGSYIHYADSVKGRFTISRDSAKNTLYLQMSSLRSEDTALYYCARL PYWGQGTLVTVSAASTKGPSVFPLAPSSKSTSGGTAALGCLVKDYFPEPV TVSWNSGALTSGVHTFPAVLQSSGLYSLSSVVTVPSSSLGTQTYICNVNH KPSNTKVDKKVEPKSCDKTHTCPPCPAPELLGGPSVFLFPPKPKDTLMISR TPEVTCVVVDVSHEDPEVKFNWYVDGVEVHNAKTKPREEQYNSTYRVV SVLTVLHQDWLNGKEYKCKVSNKALPAPIEKTISKAKGQPREPQVYTLPP SRDELTKNQVSLWCLVKGFYPSDIAVWWESYGTEWSSYKTTPPVLDSDG SFFLYSKLTVTKEEWQQGFVFSCSVMHEALHNHYTQKSLSLSPGK | ch1C7.HC.CH3C.35. 21 with knob mutation |
| 319 | EVKLVESGGGLVKPGGSLKLSCAASGFTFSSYGMSWVRQTPEKRLEWVA SISGDGGSYIHYADSVKGRFTISRDSAKNTLYLQMSSLRSEDTALYYCARL PYWGQGTLVTVSAASTKGPSVFPLAPSSKSTSGGTAALGCLVKDYFPEPV TVSWNSGALTSGVHTFPAVLQSSGLYSLSSVVTVPSSSLGTQTYICNVNH KPSNTKVDKKVEPKSCDKTHTCPPCPAPEAAGGPSVFLFPPKPKDTLMISR TPEVTCVVVDVSHEDPEVKFNWYVDGVEVHNAKTKPREEQYNSTYRVV SVLTVLHQDWLNGKEYKCKVSNKALPAPIEKTISKAKGQPREPQVYTLPP | ch1C7.HC.CH3C.35. 21 with knob and LALA mutations |

| SEQ ID NO | Sequence | Description |
|---|---|---|
| | SRDELTKNQVSLWCLVKGFYPSDIAVWWESYGTEWSSYKTTPPVLDSDG<br>SFFLYSKLTVTKEEWQQGFVFSCSVMHEALHNHYTQKSLSLSPGK | |
| 320 | EVKLVESGGGLVKPGGSLKLSCAASGFTFSSYGMSWVRQTPEKRLEWVA<br>SISGDGGSYIHYADSVKGRFTISRDSAKNTLYLQMSSLRSEDTALYYCARL<br>PYWGQGTLVTVSAASTKGPSVFPLAPSSKSTSGGTAALGCLVKDYFPEPV<br>TVSWNSGALTSGVHTFPAVLQSSGLYSLSSVVTVPSSSLGTQTYICNVNH<br>KPSNTKVDKKVEPKSCDKTHTCPPCPAPELLGGPSVFLFPPKPKDTLYITR<br>EPEVTCVVVDVSHEDPEVKFNWYVDGVEVHNAKTKPREEQYNSTYRVV<br>SVLTVLHQDWLNGKEYKCKVSNKALPAPIEKTISKAKGQPREPQVYTLPP<br>SRDELTKNQVSLWCLVKGFYPSDIAVWWESYGTEWSSYKTTPPVLDSDG<br>SFFLYSKLTVTKEEWQQGFVFSCSVMHEALHNHYTQKSLSLSPGK | ch1C7.HC.CH3C.35.<br>21 with knob and<br>YTE mutations |
| 321 | EVKLVESGGGLVKPGGSLKLSCAASGFTFSSYGMSWVRQTPEKRLEWVA<br>SISGDGGSYIHYADSVKGRFTISRDSAKNTLYLQMSSLRSEDTALYYCARL<br>PYWGQGTLVTVSAASTKGPSVFPLAPSSKSTSGGTAALGCLVKDYFPEPV<br>TVSWNSGALTSGVHTFPAVLQSSGLYSLSSVVTVPSSSLGTQTYICNVNH<br>KPSNTKVDKKVEPKSCDKTHTCPPCPAPEAAGGPSVFLFPPKPKDTLYITR<br>EPEVTCVVVDVSHEDPEVKFNWYVDGVEVHNAKTKPREEQYNSTYRVV<br>SVLTVLHQDWLNGKEYKCKVSNKALPAPIEKTISKAKGQPREPQVYTLPP<br>SRDELTKNQVSLWCLVKGFYPSDIAVWWESYGTEWSSYKTTPPVLDSDG<br>SFFLYSKLTVTKEEWQQGFVFSCSVMHEALHNHYTQKSLSLSPGK | ch1C7.HC.CH3C.35.<br>21 with knob, LALA,<br>and YTE mutations |
| 322 | EVKLVESGGGLVKPGGSLKLSCAASGFTFSSYGMSWVRQTPEKRLEWVA<br>SISGDGGSYIHYADSVKGRFTISRDSAKNTLYLQMSSLRSEDTALYYCARL<br>PYWGQGTLVTVSAASTKGPSVFPLAPSSKSTSGGTAALGCLVKDYFPEPV<br>TVSWNSGALTSGVHTFPAVLQSSGLYSLSSVVTVPSSSLGTQTYICNVNH<br>KPSNTKVDKKVEPKSCDKTHTCPPCPAPEAAGGPSVFLFPPKPKDTLYITR<br>EPEVTCVVVDVSHEDPEVKFNWYVDGVEVHNAKTKPREEQYNSTYRVV<br>SVLTVLHQDWLNGKEYKCKVSNKALGAPIEKTISKAKGQPREPQVYTLPP<br>SRDELTKNQVSLWCLVKGFYPSDIAVWWESYGTEWSSYKTTPPVLDSDG<br>SFFLYSKLTVTKEEWQQGFVFSCSVMHEALHNHYTQKSLSLSPGK | ch1C7.HC.CH3C.35.<br>21 with knob,<br>LALAPG, and YTE<br>mutations |
| 323 | EVKLVESGGGLVKPGGSLKLSCAASGFTFSSYGMSWVRQTPEKRLEWVA<br>SISGDGGSYIHYADSVKGRFTISRDSAKNTLYLQMSSLRSEDTALYYCARL<br>PYWGQGTLVTVSAASTKGPSVFPLAPSSKSTSGGTAALGCLVKDYFPEPV<br>TVSWNSGALTSGVHTFPAVLQSSGLYSLSSVVTVPSSSLGTQTYICNVNH<br>KPSNTKVDKKVEPKSCDKTHTCPPCPAPELLGGPSVFLFPPKPKDTLMISR<br>TPEVTCVVVDVSHEDPEVKFNWYVDGVEVHNAKTKPREEQYNSTYRVV<br>SVLTVLHQDWLNGKEYKCKVSNKALPAPIEKTISKAKGQPREPQVYTLPP<br>SRDELTKNQVSLSCAVKGFYPSDIAVWWESYGTEWSSYKTTPPVLDSDGS<br>FFLVSKLTVTKEEWQQGFVFSCSVMHEALHNHYTQKSLSLSPGK | ch1C7.HC.CH3C.35.<br>21 with hole<br>mutations |
| 324 | EVKLVESGGGLVKPGGSLKLSCAASGFTFSSYGMSWVRQTPEKRLEWVA<br>SISGDGGSYIHYADSVKGRFTISRDSAKNTLYLQMSSLRSEDTALYYCARL<br>PYWGQGTLVTVSAASTKGPSVFPLAPSSKSTSGGTAALGCLVKDYFPEPV<br>TVSWNSGALTSGVHTFPAVLQSSGLYSLSSVVTVPSSSLGTQTYICNVNH<br>KPSNTKVDKKVEPKSCDKTHTCPPCPAPEAAGGPSVFLFPPKPKDTLMISR<br>TPEVTCVVVDVSHEDPEVKFNWYVDGVEVHNAKTKPREEQYNSTYRVV<br>SVLTVLHQDWLNGKEYKCKVSNKALPAPIEKTISKAKGQPREPQVYTLPP<br>SRDELTKNQVSLSCAVKGFYPSDIAVWWESYGTEWSSYKTTPPVLDSDGS<br>FFLVSKLTVTKEEWQQGFVFSCSVMHEALHNHYTQKSLSLSPGK | ch1C7.HC.CH3C.35.<br>21 with hole and<br>LALA mutations |
| 325 | EVKLVESGGGLVKPGGSLKLSCAASGFTFSSYGMSWVRQTPEKRLEWVA<br>SISGDGGSYIHYADSVKGRFTISRDSAKNTLYLQMSSLRSEDTALYYCARL<br>PYWGQGTLVTVSAASTKGPSVFPLAPSSKSTSGGTAALGCLVKDYFPEPV<br>TVSWNSGALTSGVHTFPAVLQSSGLYSLSSVVTVPSSSLGTQTYICNVNH<br>KPSNTKVDKKVEPKSCDKTHTCPPCPAPEAAGGPSVFLFPPKPKDTLMISR<br>TPEVTCVVVDVSHEDPEVKFNWYVDGVEVHNAKTKPREEQYNSTYRVV<br>SVLTVLHQDWLNGKEYKCKVSNKALGAPIEKTISKAKGQPREPQVYTLPP<br>SRDELTKNQVSLSCAVKGFYPSDIAVVVWESYGTEWSSYKTTPPVLDSDGS<br>FFLVSKLTVTKEEWQQGFVFSCSVMHEALHNHYTQKSLSLSPGK | ch1C7.HC.CH3C.35.<br>21 with hole and<br>LALAPG mutations |
| 326 | EVKLVESGGGLVKPGGSLKLSCAASGFTFSSYGMSWVRQTPEKRLEWVA<br>SISGDGGSYIHYADSVKGRFTISRDSAKNTLYLQMSSLRSEDTALYYCARL<br>PYWGQGTLVTVSAASTKGPSVFPLAPSSKSTSGGTAALGCLVKDYFPEPV<br>TVSWNSGALTSGVHTFPAVLQSSGLYSLSSVVTVPSSSLGTQTYICNVNH<br>KPSNTKVDKKVEPKSCDKTHTCPPCPAPELLGGPSVFLFPPKPKDTLYITR<br>EPEVTCVVVDVSHEDPEVKFNWYVDGVEVHNAKTKPREEQYNSTYRVV<br>SVLTVLHQDWLNGKEYKCKVSNKALPAPIEKTISKAKGQPREPQVYTLPP<br>SRDELTKNQVSLSCAVKGFYPSDIAVWWESYGTEWSSYKTTPPVLDSDGS<br>FFLVSKLTVTKEEWQQGFVFSCSVMHEALHNHYTQKSLSLSPGK | ch1C7.HC.CH3C.35.<br>21 with hole and YTE<br>mutations |

| SEQ ID NO | Sequence | Description |
|---|---|---|
| 327 | EVKLVESGGGLVKPGGSLKLSCAASGFTFSSYGMSWVRQTPEKRLEWVA<br>SISGDGGSYIHYADSVKGRFTISRDSAKNTLYLQMSSLRSEDTALYYCARL<br>PYWGQGTLVTVSAASTKGPSVFPPLAPSSKSTSGGTAALGCLVKDYFPEPV<br>TVSWNSGALTSGVHTFPAVLQSSGLYSLSSVVTVPSSSLGTQTYICNVNH<br>KPSNTKVDKKVEPKSCDKTHTCPPCPAPEAAGGPSVFLFPPKPKDTLYITR<br>EPEVTCVVVDVSHEDPEVKFNWYVDGVEVHNAKTKPREEQYNSTYRVV<br>SVLTVLHQDWLNGKEYKCKVSNKALPAPIEKTISKAKGQPREPQVYTLPP<br>SRDELTKNQVSLSCAVKGFYPSDIAVVWESYGTEWSSYKTTPPVLDSDGS<br>FFLVSKLTVTKEEWQQGFVFSCSVMHEALHNHYTQKSLSLSPGK | ch1C7.HC.CH3C.35.21 with hole, LALA, and YTE mutations |
| 328 | EVKLVESGGGLVKPGGSLKLSCAASGFTFSSYGMSWVRQTPEKRLEWVA<br>SISGDGGSYIHYADSVKGRFTISRDSAKNTLYLQMSSLRSEDTALYYCARL<br>PYWGQGTLVTVSAASTKGPSVFPPLAPSSKSTSGGTAALGCLVKDYFPEPV<br>TVSWNSGALTSGVHTFPAVLQSSGLYSLSSVVTVPSSSLGTQTYICNVNH<br>KPSNTKVDKKVEPKSCDKTHTCPPCPAPEAAGGPSVFLFPPKPKDTLYITR<br>EPEVTCVVVDVSHEDPEVKFNWYVDGVEVHNAKTKPREEQYNSTYRVV<br>SVLTVLHQDWLNGKEYKCKVSNKALGAPIEKTISKAKGQPREPQVYTLPP<br>SRDELTKNQVSLSCAVKGFYPSDIAVVWESYGTEWSSYKTTPPVLDSDGS<br>FFLVSKLTVTKEEWQQGFVFSCSVMHEALHNHYTQKSLSLSPGK | ch1C7.HC.CH3C.35.21 with hole, LALAPG, and YTE mutations |
| 329 | EVKLVESGGGLVKPGGSLKLSCAASGFTFSSYGMSWVRQTPEKRLEWVA<br>SISGDGGSYIHYADSVKGRFTISRDSAKNTLYLQMSSLRSEDTALYYCARL<br>PYWGQGTLVTVSAASTKGPSVFPPLAPSSKSTSGGTAALGCLVKDYFPEPV<br>TVSWNSGALTSGVHTFPAVLQSSGLYSLSSVVTVPSSSLGTQTYICNVNH<br>KPSNTKVDKKVEPKSCDKTHTCPPCPAPELLGGPSVFLFPPKPKDTLMISR<br>TPEVTCVVVDVSHEDPEVKFNWYVDGVEVHNAKTKPREEQYNSTYRVV<br>SVLTVLHQDWLNGKEYKCKVSNKALPAPIEKTISKAKGQPREPQVYTLPP<br>SRDELTKNQVSLSCAVKGFYPSDIAVEWESNGQPENNYKTTPPVLDSDGS<br>FFLVSKLTVDKSRWQQGNVFSCSVMHEALHNHYTQKSLSLSPGK | ch1C7.HC.Fc sequence with hole mutations |
| 330 | EVKLVESGGGLVKPGGSLKLSCAASGFTFSSYGMSWVRQTPEKRLEWVA<br>SISGDGGSYIHYADSVKGRFTISRDSAKNTLYLQMSSLRSEDTALYYCARL<br>PYWGQGTLVTVSAASTKGPSVFPPLAPSSKSTSGGTAALGCLVKDYFPEPV<br>TVSWNSGALTSGVHTFPAVLQSSGLYSLSSVVTVPSSSLGTQTYICNVNH<br>KPSNTKVDKKVEPKSCDKTHTCPPCPAPEAAGGPSVFLFPPKPKDTLMISR<br>TPEVTCVVVDVSHEDPEVKFNWYVDGVEVHNAKTKPREEQYNSTYRVV<br>SVLTVLHQDWLNGKEYKCKVSNKALPAPIEKTISKAKGQPREPQVYTLPP<br>SRDELTKNQVSLSCAVKGFYPSDIAVEWESNGQPENNYKTTPPVLDSDGS<br>FFLVSKLTVDKSRWQQGNVFSCSVMHEALHNHYTQKSLSLSPGK | ch1C7.HC.Fc sequence with hole and LALA mutations |
| 331 | EVKLVESGGGLVKPGGSLKLSCAASGFTFSSYGMSWVRQTPEKRLEWVA<br>SISGDGGSYIHYADSVKGRFTISRDSAKNTLYLQMSSLRSEDTALYYCARL<br>PYWGQGTLVTVSAASTKGPSVFPPLAPSSKSTSGGTAALGCLVKDYFPEPV<br>TVSWNSGALTSGVHTFPAVLQSSGLYSLSSVVTVPSSSLGTQTYICNVNH<br>KPSNTKVDKKVEPKSCDKTHTCPPCPAPELLGGPSVFLFPPKPKDTLYITR<br>EPEVTCVVVDVSHEDPEVKFNWYVDGVEVHNAKTKPREEQYNSTYRVV<br>SVLTVLHQDWLNGKEYKCKVSNKALPAPIEKTISKAKGQPREPQVYTLPP<br>SRDELTKNQVSLSCAVKGFYPSDIAVEWESNGQPENNYKTTPPVLDSDGS<br>FFLVSKLTVDKSRWQQGNVFSCSVMHEALHNHYTQKSLSLSPGK | ch1C7.HC.Fc sequence with hole and YTE mutations |
| 332 | EVKLVESGGGLVKPGGSLKLSCAASGFTFSSYGMSWVRQTPEKRLEWVA<br>SISGDGGSYIHYADSVKGRFTISRDSAKNTLYLQMSSLRSEDTALYYCARL<br>PYWGQGTLVTVSAASTKGPSVFPPLAPSSKSTSGGTAALGCLVKDYFPEPV<br>TVSWNSGALTSGVHTFPAVLQSSGLYSLSSVVTVPSSSLGTQTYICNVNH<br>KPSNTKVDKKVEPKSCDKTHTCPPCPAPEAAGGPSVFLFPPKPKDTLYITR<br>EPEVTCVVVDVSHEDPEVKFNWYVDGVEVHNAKTKPREEQYNSTYRVV<br>SVLTVLHQDWLNGKEYKCKVSNKALPAPIEKTISKAKGQPREPQVYTLPP<br>SRDELTKNQVSLSCAVKGFYPSDIAVEWESNGQPENNYKTTPPVLDSDGS<br>FFLVSKLTVDKSRWQQGNVFSCSVMHEALHNHYTQKSLSLSPGK | ch1C7.HC.Fc sequence with hole, LALA, and YTE mutations |
| 333 | EVKLVESGGGLVKPGGSLKLSCAASGFTFSSYGMSWVRQTPEKRLEWVA<br>SISGDGGSYIHYADSVKGRFTISRDSAKNTLYLQMSSLRSEDTALYYCARL<br>PYWGQGTLVTVSAASTKGPSVFPPLAPSSKSTSGGTAALGCLVKDYFPEPV<br>TVSWNSGALTSGVHTFPAVLQSSGLYSLSSVVTVPSSSLGTQTYICNVNH<br>KPSNTKVDKKVEPKSCDKTHTCPPCPAPEAAGGPSVFLFPPKPKDTLYITR<br>EPEVTCVVVDVSHEDPEVKFNWYVDGVEVHNAKTKPREEQYNSTYRVV<br>SVLTVLHQDWLNGKEYKCKVSNKALGAPIEKTISKAKGQPREPQVYTLPP<br>SRDELTKNQVSLSCAVKGFYPSDIAVEWESNGQPENNYKTTPPVLDSDGS<br>FFLVSKLTVDKSRWQQGNVFSCSVMHEALHNHYTQKSLSLSPGK | ch1C7.HC.Fc sequence with hole, LALAPG, and YTE mutations |
| 334 | EVKLVESGGGLVKPGGSLKLSCAASGFTFSSYGMSWVRQTPEKRLEWVA<br>SISGDGGSYIHYADSVKGRFTISRDSAKNTLYLQMSSLRSEDTALYYCARL<br>PYWGQGTLVTVSAASTKGPSVFPPLAPSSKSTSGGTAALGCLVKDYFPEPV | ch1C7.HC.Fc sequence with knob mutation |

| SEQ ID NO | Sequence | Description |
|---|---|---|
| | TVSWNSGALTSGVHTFPAVLQSSGLYSLSSVVTVPSSSLGTQTYICNVNH<br>KPSNTKVDKKVEPKSCDKTHTCPPCPAPELLGGPSVFLFPPKPKDTLMISR<br>TPEVTCVVVDVSHEDPEVKFNWYVDGVEVHNAKTKPREEQYNSTYRVV<br>SVLTVLHQDWLNGKEYKCKVSNKALPAPIEKTISKAKGQPREPQVYTLPP<br>SRDELTKNQVSLWCLVKGFYPSDIAVEWESNGQPENNYKTTPPVLDSDGS<br>FFLYSKLTVDKSRWQQGNVFSCSVMHEALHNHYTQKSLSLSPGK | |
| 335 | EVKLVESGGGLVKPGGSLKLSCAASGFTFSSYGMSWVRQTPEKRLEWVA<br>SISGDGGSYIHYADSVKGRFTISRDSAKNTLYLQMSSLRSEDTALYYCARL<br>PYWGQGTLVTVSAASTKGPSVFPLAPSSKSTSGGTAALGCLVKDYFPEPV<br>TVSWNSGALTSGVHTFPAVLQSSGLYSLSSVVTVPSSSLGTQTYICNVNH<br>KPSNTKVDKKVEPKSCDKTHTCPPCPAPEAAGGPSVFLFPPKPKDTLMISR<br>TPEVTCVVVDVSHEDPEVKFNWYVDGVEVHNAKTKPREEQYNSTYRVV<br>SVLTVLHQDWLNGKEYKCKVSNKALPAPIEKTISKAKGQPREPQVYTLPP<br>SRDELTKNQVSLWCLVKGFYPSDIAVEWESNGQPENNYKTTPPVLDSDGS<br>FFLYSKLTVDKSRWQQGNVFSCSVMHEALHNHYTQKSLSLSPGK | ch1C7.HC.Fc sequence with knob and LALA mutations |
| 336 | EVKLVESGGGLVKPGGSLKLSCAASGFTFSSYGMSWVRQTPEKRLEWVA<br>SISGDGGSYIHYADSVKGRFTISRDSAKNTLYLQMSSLRSEDTALYYCARL<br>PYWGQGTLVTVSAASTKGPSVFPLAPSSKSTSGGTAALGCLVKDYFPEPV<br>TVSWNSGALTSGVHTFPAVLQSSGLYSLSSVVTVPSSSLGTQTYICNVNH<br>KPSNTKVDKKVEPKSCDKTHTCPPCPAPEAAGGPSVFLFPPKPKDTLMISR<br>TPEVTCVVVDVSHEDPEVKFNWYVDGVEVHNAKTKPREEQYNSTYRVV<br>SVLTVLHQDWLNGKEYKCKVSNKALGAPIEKTISKAKGQPREPQVYTLPP<br>SRDELTKNQVSLWCLVKGFYPSDIAVEWESNGQPENNYKTTPPVLDSDGS<br>FFLYSKLTVDKSRWQQGNVFSCSVMHEALHNHYTQKSLSLSPGK | ch1C7.HC.Fc sequence with knob and LALAPG mutations |
| 337 | EVKLVESGGGLVKPGGSLKLSCAASGFTFSSYGMSWVRQTPEKRLEWVA<br>SISGDGGSYIHYADSVKGRFTISRDSAKNTLYLQMSSLRSEDTALYYCARL<br>PYWGQGTLVTVSAASTKGPSVFPLAPSSKSTSGGTAALGCLVKDYFPEPV<br>TVSWNSGALTSGVHTFPAVLQSSGLYSLSSVVTVPSSSLGTQTYICNVNH<br>KPSNTKVDKKVEPKSCDKTHTCPPCPAPELLGGPSVFLFPPKPKDTLYITR<br>EPEVTCVVVDVSHEDPEVKFNWYVDGVEVHNAKTKPREEQYNSTYRVV<br>SVLTVLHQDWLNGKEYKCKVSNKALPAPIEKTISKAKGQPREPQVYTLPP<br>SRDELTKNQVSLWCLVKGFYPSDIAVEWESNGQPENNYKTTPPVLDSDGS<br>FFLYSKLTVDKSRWQQGNVFSCSVMHEALHNHYTQKSLSLSPGK | ch1C7.HC.Fc sequence with knob and YTE mutations |
| 338 | EVKLVESGGGLVKPGGSLKLSCAASGFTFSSYGMSWVRQTPEKRLEWVA<br>SISGDGGSYIHYADSVKGRFTISRDSAKNTLYLQMSSLRSEDTALYYCARL<br>PYWGQGTLVTVSAASTKGPSVFPLAPSSKSTSGGTAALGCLVKDYFPEPV<br>TVSWNSGALTSGVHTFPAVLQSSGLYSLSSVVTVPSSSLGTQTYICNVNH<br>KPSNTKVDKKVEPKSCDKTHTCPPCPAPEAAGGPSVFLFPPKPKDTLYITR<br>EPEVTCVVVDVSHEDPEVKFNWYVDGVEVHNAKTKPREEQYNSTYRVV<br>SVLTVLHQDWLNGKEYKCKVSNKALPAPIEKTISKAKGQPREPQVYTLPP<br>SRDELTKNQVSLWCLVKGFYPSDIAVEWESNGQPENNYKTTPPVLDSDGS<br>FFLYSKLTVDKSRWQQGNVFSCSVMHEALHNHYTQKSLSLSPGK | ch1C7.HC.Fc sequence with knob, LALA, and YTE mutations |
| 339 | EVKLVESGGGLVKPGGSLKLSCAASGFTFSSYGMSWVRQTPEKRLEWVA<br>SISGDGGSYIHYADSVKGRFTISRDSAKNTLYLQMSSLRSEDTALYYCARL<br>PYWGQGTLVTVSAASTKGPSVFPLAPSSKSTSGGTAALGCLVKDYFPEPV<br>TVSWNSGALTSGVHTFPAVLQSSGLYSLSSVVTVPSSSLGTQTYICNVNH<br>KPSNTKVDKKVEPKSCDKTHTCPPCPAPEAAGGPSVFLFPPKPKDTLYITR<br>EPEVTCVVVDVSHEDPEVKFNWYVDGVEVHNAKTKPREEQYNSTYRVV<br>SVLTVLHQDWLNGKEYKCKVSNKALGAPIEKTISKAKGQPREPQVYTLPP<br>SRDELTKNQVSLWCLVKGFYPSDIAVEWESNGQPENNYKTTPPVLDSDGS<br>FFLYSKLTVDKSRWQQGNVFSCSVMHEALHNHYTQKSLSLSPGK | ch1C7.HC.Fc sequence with knob, LALAPG, and YTE mutations |
| 340 | APEAAGGPSVFLFPPKPKDTLYITREPEVTCVVVDVSHEDPEVKFNWYVD<br>GVEVHNAKTKPREEQYNSTYRVVSVLTVLHQDWLNGKEYKCKVSNKAL<br>GAPIEKTISKAKGQPREPQVYTLPPSRDELTKNQVSLTCLVKGFYPSDIAV<br>EWESYGTEWSSYKTTPPVLDSDGSFFLYSKLTVTKEEWQQGVFSCSVM<br>HEALHNHYTQKSLSLSPGK | Clone CH3C.35.8 (Clone CH3C.35.20 with YTE and LALAPG mutations) |
| 341 | APEAAGGPSVFLFPPKPKDTLYITREPEVTCVVVDVSHEDPEVKFNWYVD<br>GVEVHNAKTKPREEQYNSTYRVVSVLTVLHQDWLNGKEYKCKVSNKAL<br>GAPIEKTISKAKGQPREPQVYTLPPSRDELTKNQVSLTCLVKGFYPSDIAV<br>EWESFGTEWSSYKTTPPVLDSDGSFFLYSKLTVTKEEWQQGFVFSCSVMH<br>EALHNHYTQKSLSLSPGK | Clone CH3C.35.9 (Clone CH3C.35.21 with YTE and LALAPG mutations) |
| 342 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLWCLVKGFYPSDIAV | Clone CH3C.35.20.1 with knob mutation |

| | INFORMAL SEQUENCE LISTING | |
|---|---|---|
| SEQ ID NO | Sequence | Description |
| | EWESFGTEWSSYKTTPPVLDSDGSFFLYSKLTVTKEEWQQGFVFSCSVMH EALHNHYTQKSLSLSPGK | |
| 343 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESFGTEWSSYKTTPPVLDSDGSFFLYSKLTVTKEEWQQGFVFSCSVMH EALHNHYTQKSLSLSPGK | Clone CH3C.35.20.1 with knob and LALA mutations |
| 344 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV EWESFGTEWSSYKTTPPVLDSDGSFFLYSKLTVTKEEWQQGFVFSCSVMH EALHNHYTQKSLSLSPGK | Clone CH3C.35.20.1 with knob and LALAPG mutations |
| 345 | APELLGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESFGTEWSSYKTTPPVLDSDGSFFLYSKLTVTKEEWQQGFVFSCSVMH EALHNHYTQKSLSLSPGK | Clone CH3C.35.20.1 with knob and YTE mutations |
| 346 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESFGTEWSSYKTTPPVLDSDGSFFLYSKLTVTKEEWQQGFVFSCSVMH EALHNHYTQKSLSLSPGK | Clone CH3C.35.20.1 with knob, LALA, and YTE mutations |
| 347 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV EWESFGTEWSSYKTTPPVLDSDGSFFLYSKLTVTKEEWQQGFVFSCSVMH EALHNHYTQKSLSLSPGK | Clone CH3C.35.20.1 with knob, LALAPG, and YTE mutations |
| 348 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESFGTEWSSYKTTPPVLDSDGSFFLVSKLTVTKEEWQQGFVFSCSVMHE ALHNHYTQKSLSLSPGK | Clone CH3C.35.20.1 with hole mutations |
| 349 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESFGTEWSSYKTTPPVLDSDGSFFLVSKLTVTKEEWQQGFVFSCSVMHE ALHNHYTQKSLSLSPGK | Clone CH3C.35.20.1 with hole and LALA mutations |
| 350 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV EWESFGTEWSSYKTTPPVLDSDGSFFLVSKLTVTKEEWQQGFVFSCSVMH EALHNHYTQKSLSLSPGK | Clone CH3C.35.20.1 with hole and LALAPG mutations |
| 351 | APELLGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESFGTEWSSYKTTPPVLDSDGSFFLVSKLTVTKEEWQQGFVFSCSVMHE ALHNHYTQKSLSLSPGK | Clone CH3C.35.20.1 with hole and YTE mutations |
| 352 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESFGTEWSSYKTTPPVLDSDGSFFLVSKLTVTKEEWQQGFVFSCSVMHE ALHNHYTQKSLSLSPGK | Clone CH3C.35.20.1 with hole, LALA, and YTE, mutations |
| 353 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV EWESFGTEWSSYKTTPPVLDSDGSFFLVSKLTVTKEEWQQGFVFSCSVMH EALHNHYTQKSLSLSPGK | Clone CH3C.35.20.1 with hole, LALAPG, and YTE mutations |
| 354 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV | Clone CH3C.35.23.2 with knob mutation |

| SEQ ID NO | Sequence | Description |
|---|---|---|
| | EWESYGTEWANYKTTPPVLDSDGSFFLYSKLTVTKEEWQQGFVFSCSVM<br>HEALHNHYTQKSLSLSPGK | |
| 355 | APEAAGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLWCLVKGFYPSDIAV<br>EWESYGTEWANYKTTPPVLDSDGSFFLYSKLTVTKEEWQQGFVFSCSVM<br>HEALHNHYTQKSLSLSPGK | Clone CH3C.35.23.2 with knob and LALA mutations |
| 356 | APEAAGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>GAPIEKTISKAKGQPREPQVYTLPPSRDELTKNQVSLWCLVKGFYPSDIAV<br>EWESYGTEWANYKTTPPVLDSDGSFFLYSKLTVTKEEWQQGFVFSCSVM<br>HEALHNHYTQKSLSLSPGK | Clone CH3C.35.23.2 with knob and LALAPG mutations |
| 357 | APELLGGPSVFLFPPKPKDTLYITREPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLWCLVKGFYPSDIAV<br>EWESYGTEWANYKTTPPVLDSDGSFFLYSKLTVTKEEWQQGFVFSCSVM<br>HEALHNHYTQKSLSLSPGK | Clone CH3C.35.23.2 with knob and YTE mutations |
| 358 | APEAAGGPSVFLFPPKPKDTLYITREPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLWCLVKGFYPSDIAV<br>EWESYGTEWANYKTTPPVLDSDGSFFLYSKLTVTKEEWQQGFVFSCSVM<br>HEALHNHYTQKSLSLSPGK | Clone CH3C.35.23.2 with knob, LALA, and YTE mutations |
| 359 | APEAAGGPSVFLFPPKPKDTLYITREPEVTCVVVDVSHEDPEVKFNWYVD<br>GVEVHNAKTKPREEQYNSTYRVVSVLTVLHQDWLNGKEYKCKVSNKAL<br>GAPIEKTISKAKGQPREPQVYTLPPSRDELTKNQVSLWCLVKGFYPSDIAV<br>EWESYGTEWANYKTTPPVLDSDGSFFLYSKLTVTKEEWQQGFVFSCSVM<br>HEALHNHYTQKSLSLSPGK | Clone CH3C.35.23.2 with knob, LALAPG, and YTE mutations |
| 360 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLSCAVKGFYPSDIAVE<br>WESYGTEWANYKTTPPVLDSDGSFFLVSKLTVTKEEWQQGFVFSCSVMH<br>EALHNHYTQKSLSLSPGK | Clone CH3C.35.23.2 with hole mutations |
| 361 | APEAAGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLSCAVKGFYPSDIAVE<br>WESYGTEWANYKTTPPVLDSDGSFFLVSKLTVTKEEWQQGFVFSCSVMH<br>EALHNHYTQKSLSLSPGK | Clone CH3C.35.23.2 with hole and LALA mutations |
| 362 | APEAAGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>GAPIEKTISKAKGQPREPQVYTLPPSRDELTKNQVSLSCAVKGFYPSDIAV<br>EWESYGTEWANYKTTPPVLDSDGSFFLVSKLTVTKEEWQQGFVFSCSVM<br>HEALHNHYTQKSLSLSPGK | Clone CH3C.35.23.2 with hole and LALAPG mutations |
| 363 | APELLGGPSVFLFPPKPKDTLYITREPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLSCAVKGFYPSDIAVE<br>WESYGTEWANYKTTPPVLDSDGSFFLVSKLTVTKEEWQQGFVFSCSVMH<br>EALHNHYTQKSLSLSPGK | Clone CH3C.35.23.2 with hole and YTE mutations |
| 364 | APEAAGGPSVFLFPPKPKDTLYITREPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLSCAVKGFYPSDIAVE<br>WESYGTEWANYKTTPPVLDSDGSFFLVSKLTVTKEEWQQGFVFSCSVMH<br>EALHNHYTQKSLSLSPGK | Clone CH3C.35.23.2 with hole, LALA, and YTE mutations |
| 365 | APEAAGGPSVFLFPPKPKDTLYITREPEVTCVVVDVSHEDPEVKFNWYVD<br>GVEVHNAKTKPREEQYNSTYRVVSVLTVLHQDWLNGKEYKCKVSNKAL<br>GAPIEKTISKAKGQPREPQVYTLPPSRDELTKNQVSLSCAVKGFYPSDIAV<br>EWESYGTEWANYKTTPPVLDSDGSFFLVSKLTVTKEEWQQGFVFSCSVM<br>HEALHNHYTQKSLSLSPGK | Clone CH3C.35.23.2 with hole, LALAPG, and YTE mutations |
| 366 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLWCLVKGFYPSDIAV | Clone CH3C.35.23.3 with knob mutation |

| SEQ ID NO | Sequence | Description |
|---|---|---|
| | EWESYGTEWVNYKTTPPVLDSDGSFFLYSKLTVTKEEWQQGFVFSCSVM<br>HEALHNHYTQKSLSLSPGK | |
| 367 | APEAAGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLWCLVKGFYPSDIAV<br>EWESYGTEWVNYKTTPPVLDSDGSFFLYSKLTVTKEEWQQGFVFSCSVM<br>HEALHNHYTQKSLSLSPGK | Clone CH3C.35.23.3 with knob and LALA mutations |
| 368 | APEAAGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>GAPIEKTISKAKGQPREPQVYTLPPSRDELTKNQVSLWCLVKGFYPSDIAV<br>EWESYGTEWVNYKTTPPVLDSDGSFFLYSKLTVTKEEWQQGFVFSCSVM<br>HEALHNHYTQKSLSLSPGK | Clone CH3C.35.23.3 with knob and LALAPG mutations |
| 369 | APELLGGPSVFLFPPKPKDTLYITREPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLWCLVKGFYPSDIAV<br>EWESYGTEWVNYKTTPPVLDSDGSFFLYSKLTVTKEEWQQGFVFSCSVM<br>HEALHNHYTQKSLSLSPGK | Clone CH3C.35.23.3 with knob and YTE mutations |
| 370 | APEAAGGPSVFLFPPKPKDTLYITREPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLWCLVKGFYPSDIAV<br>EWESYGTEWVNYKTTPPVLDSDGSFFLYSKLTVTKEEWQQGFVFSCSVM<br>HEALHNHYTQKSLSLSPGK | Clone CH3C.35.23.3 with knob, LALA, and YTE mutations |
| 371 | APEAAGGPSVFLFPPKPKDTLYITREPEVTCVVVDVSHEDPEVKFNWYVD<br>GVEVHNAKTKPREEQYNSTYRVVSVLTVLHQDWLNGKEYKCKVSNKAL<br>GAPIEKTISKAKGQPREPQVYTLPPSRDELTKNQVSLWCLVKGFYPSDIAV<br>EWESYGTEWVNYKTTPPVLDSDGSFFLYSKLTVTKEEWQQGFVFSCSVM<br>HEALHNHYTQKSLSLSPGK | Clone CH3C.35.23.3 with knob, LALAPG, and YTE mutations |
| 372 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLSCAVKGFYPSDIAVE<br>WESYGTEWVNYKTTPPVLDSDGSFFLVSKLTVTKEEWQQGFVFSCSVMH<br>EALHNHYTQKSLSLSPGK | Clone CH3C.3523.3 with hole mutations |
| 373 | APEAAGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLSCAVKGFYPSDIAVE<br>WESYGTEWVNYKTTPPVLDSDGSFFLVSKLTVTKEEWQQGFVFSCSVMH<br>EALHNHYTQKSLSLSPGK | Clone CH3C.35.23.3 with hole and LALA mutations |
| 374 | APEAAGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>GAPIEKTISKAKGQPREPQVYTLPPSRDELTKNQVSLSCAVKGFYPSDIAV<br>EWESYGTEWVNYKTTPPVLDSDGSFFLVSKLTVTKEEWQQGFVFSCSVM<br>HEALHNHYTQKSLSLSPGK | Clone CH3C.35.23.3 with hole and LALAPG mutations |
| 375 | APELLGGPSVFLFPPKPKDTLYITREPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLSCAVKGFYPSDIAVE<br>WESYGTEWVNYKTTPPVLDSDGSFFLVSKLTVTKEEWQQGFVFSCSVMH<br>EALHNHYTQKSLSLSPGK | Clone CH3C.35.23.3 with hole and YTE mutations |
| 376 | APEAAGGPSVFLFPPKPKDTLYITREPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLSCAVKGFYPSDIAVE<br>WESYGTEWVNYKTTPPVLDSDGSFFLVSKLTVTKEEWQQGFVFSCSVMH<br>EALHNHYTQKSLSLSPGK | Clone CH3C.35.23.3 with hole, LALA, and YTE mutations |
| 377 | APEAAGGPSVFLFPPKPKDTLYITREPEVTCVVVDVSHEDPEVKFNWYVD<br>GVEVHNAKTKPREEQYNSTYRVVSVLTVLHQDWLNGKEYKCKVSNKAL<br>GAPIEKTISKAKGQPREPQVYTLPPSRDELTKNQVSLSCAVKGFYPSDIAV<br>EWESYGTEWVNYKTTPPVLDSDGSFFLVSKLTVTKEEWQQGFVFSCSVM<br>HEALHNHYTQKSLSLSPGK | Clone CH3C.35.23.3 with hole, LALAPG, and YTE mutations |
| 378 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLWCLVKGFYPSDIAV | Clone CH3C.35.23.4 with knob mutation |

INFORMAL SEQUENCE LISTING

| SEQ ID NO | Sequence | Description |
|---|---|---|
| | EWESYGTEWSNYKTTPPVLDSDGSFFLYSKLTVSKEEWQQGFVFSCSVM HEALHNHYTQKSLSLSPGK | |
| 379 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESYGTEWSNYKTTPPVLDSDGSFFLYSKLTVSKEEWQQGFVFSCSVM HEALHNHYTQKSLSLSPGK | Clone CH3C.35.23.4 with knob and LALA mutations |
| 380 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV EWESYGTEWSNYKTTPPVLDSDGSFFLYSKLTVSKEEWQQGFVFSCSVM HEALHNHYTQKSLSLSPGK | Clone CH3C.35.23.4 with knob and LALAPG mutations |
| 381 | APELLGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESYGTEWSNYKTTPPVLDSDGSFFLYSKLTVSKEEWQQGFVFSCSVM HEALHNHYTQKSLSLSPGK | Clone CH3C.35.23.4 with knob and YTE mutations |
| 382 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESYGTEWSNYKTTPPVLDSDGSFFLYSKLTVSKEEWQQGFVFSCSVM HEALHNHYTQKSLSLSPGK | Clone CH3C.35.23.4 with knob, LALA, and YTE mutations |
| 383 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV EWESYGTEWSNYKTTPPVLDSDGSFFLYSKLTVSKEEWQQGFVFSCSVM HEALHNHYTQKSLSLSPGK | Clone CH3C.35.23.4 with knob, LALAPG, and YTE mutations |
| 384 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESYGTEWSNYKTTPPVLDSDGSFFLVSKLTVSKEEWQQGFVFSCSVMH EALHNHYTQKSLSLSPGK | Clone CH3C.3523.4 with hole mutations |
| 385 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESYGTEWSNYKTTPPVLDSDGSFFLVSKLTVSKEEWQQGFVFSCSVMH EALHNHYTQKSLSLSPGK | Clone CH3C.35.23.4 with hole and LALA mutations |
| 386 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV EWESYGTEWSNYKTTPPVLDSDGSFFLVSKLTVSKEEWQQGFVFSCSVM HEALHNHYTQKSLSLSPGK | Clone CH3C.35.23.4 with hole and LALAPG mutations |
| 387 | APELLGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESYGTEWSNYKTTPPVLDSDGSFFLVSKLTVSKEEWQQGFVFSCSVMH EALHNHYTQKSLSLSPGK | Clone CH3C.35.23.4 with hole and YTE mutations |
| 388 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESYGTEWSNYKTTPPVLDSDGSFFLVSKLTVSKEEWQQGFVFSCSVMH EALHNHYTQKSLSLSPGK | Clone CH3C.35.23.4 with hole, LALA, and YTE mutations |
| 389 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV EWESYGTEWSNYKTTPPVLDSDGSFFLVSKLTVSKEEWQQGFVFSCSVM HEALHNHYTQKSLSLSPGK | Clone CH3C.35.23.4 with hole, LALAPG, and YTE mutations |

| SEQ ID NO | Sequence | Description |
|---|---|---|
| 390 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV LWESYGTEWASYKTTPPVLDSDGSFFLYSKLTVTKEEWQQGFVFSCSVM HEALHNHYTQKSLSLSPGK | Clone CH3C.35.21.17.2 with knob mutation |
| 391 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV LWESYGTEWASYKTTPPVLDSDGSFFLYSKLTVTKEEWQQGFVFSCSVM HEALHNHYTQKSLSLSPGK | Clone CH3C.35.21.17.2 with knob and LALA mutations |
| 392 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV LWESYGTEWASYKTTPPVLDSDGSFFLYSKLTVTKEEWQQGFVFSCSVM HEALHNHYTQKSLSLSPGK | Clone CH3C.35.21.17.2 with knob and LALAPG mutations |
| 393 | APELLGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV LWESYGTEWASYKTTPPVLDSDGSFFLYSKLTVTKEEWQQGFVFSCSVM HEALHNHYTQKSLSLSPGK | Clone CH3C.35.21.17.2 with knob and YTE mutations |
| 394 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV LWESYGTEWASYKTTPPVLDSDGSFFLYSKLTVTKEEWQQGFVFSCSVM HEALHNHYTQKSLSLSPGK | Clone CH3C.35.21.17.2 with knob, LALA, and YTE mutations |
| 395 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV LWESYGTEWASYKTTPPVLDSDGSFFLYSKLTVTKEEWQQGFVFSCSVM HEALHNHYTQKSLSLSPGK | Clone CH3C.35.21.17.2 with knob, LALAPG, and YTE mutations |
| 396 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVL WESYGTEWASYKTTPPVLDSDGSFFLVSKLTVTKEEWQQGFVFSCSVMH EALHNHYTQKSLSLSPGK | Clone CH3C.35.21.17.2 with hole mutations |
| 397 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVL WESYGTEWASYKTTPPVLDSDGSFFLVSKLTVTKEEWQQGFVFSCSVMH EALHNHYTQKSLSLSPGK | Clone CH3C.35.21.17.2 with hole and LALA mutations |
| 398 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV LWESYGTEWASYKTTPPVLDSDGSFFLVSKLTVTKEEWQQGFVFSCSVM HEALHNHYTQKSLSLSPGK | Clone CH3C.35.21.17.2 with hole and LALAPG mutations |
| 399 | APELLGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVL WESYGTEWASYKTTPPVLDSDGSFFLVSKLTVTKEEWQQGFVFSCSVMH EALHNHYTQKSLSLSPGK | Clone CH3C.35.21.17.2 with hole and YTE mutations |
| 400 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVL WESYGTEWASYKTTPPVLDSDGSFFLVSKLTVTKEEWQQGFVFSCSVMH EALHNHYTQKSLSLSPGK | Clone CH3C.35.21.17.2 with hole, LALA, and YTE mutations |
| 401 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV LWESYGTEWASYKTTPPVLDSDGSFFLVSKLTVTKEEWQQGFVFSCSVM HEALHNHYTQKSLSLSPGK | Clone CH3C.35.21.17.2 with hole, LALAPG, and YTE mutations |

INFORMAL SEQUENCE LISTING

| SEQ ID NO | Sequence | Description |
|---|---|---|
| 402 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK | Clone CH3C.35.23 with knob mutation |
| 403 | APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK | Clone CH3C.35.23 with knob and LALA mutations |
| 404 | APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK | Clone CH3C.35.23 with knob and LALAPG mutations |
| 405 | APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK | Clone CH3C.35.23 with knob and YTE mutations |
| 406 | APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK | Clone CH3C.35.23 with knob, LALA, and YTE mutations |
| 407 | APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK | Clone CH3C.35.23 with knob, LALAPG, and YTE mutations |
| 408 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK | Clone CH3C.3523 with hole mutations |
| 409 | APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK | Clone CH3C.35.23 with hole and LALA mutations |
| 410 | APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK | Clone CH3C.35.23 with hole and LALAPG mutations |
| 411 | APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK | Clone CH3C.35.23 with hole and YTE mutations |
| 412 | APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK | Clone CH3C.35.23 with hole, LALA, and YTE mutations |
| 413 | APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK | Clone CH3C.35.23 with hole, LALAPG, and YTE mutations |

| SEQ ID NO | Sequence | Description |
|---|---|---|
| 414 | EVKLVESGGGLVKPGGSLKLSCAASGFTFSSYGMSWVRQTPEKRLEWVA SISGDGGSYIHYADSVKGRFTISRDSAKNTLYLQMSSLRSEDTALYYCARL PYWGQGTLVTVSAASTKGPSVFPLAPSSKSTSGGTAALGCLVKDYFPEPV TVSWNSGALTSGVHTFPAVLQSSGLYSLSSVVTVPSSSLGTQTYICNVNH KPSNTKVDKKVEPKSCDKTHTCPPCPAPELLGGPSVFLFPPKPKDTLMISR TPEVTCVVVDVSHEDPEVKFNWYVDGVEVHNAKTKPREEQYNSTYRVV SVLTVLHQDWLNGKEYKCKVSNKALPAPIEKTISKAKGQPREPQVYTLPP SRDELTKNQVSLTCLVKGFYPSDIAVEWESFGTEWSSYKTTPPVLDSDGSF FLYSKLTVTKEEWQQGFVFSCSVMHEALHNHYTQKSLSLSPGK | ch1C7.HC.CH3C.35. 20.1 |
| 415 | EVKLVESGGGLVKPGGSLKLSCAASGFTFSSYGMSWVRQTPEKRLEWVA SISGDGGSYIHYADSVKGRFTISRDSAKNTLYLQMSSLRSEDTALYYCARL PYWGQGTLVTVSAASTKGPSVFPLAPSSKSTSGGTAALGCLVKDYFPEPV TVSWNSGALTSGVHTFPAVLQSSGLYSLSSVVTVPSSSLGTQTYICNVNH KPSNTKVDKKVEPKSCDKTHTCPPCPAPELLGGPSVFLFPPKPKDTLMISR TPEVTCVVVDVSHEDPEVKFNWYVDGVEVHNAKTKPREEQYNSTYRVV SVLTVLHQDWLNGKEYKCKVSNKALPAPIEKTISKAKGQPREPQVYTLPP SRDELTKNQVSLTCLVKGFYPSDIAVEWESYGTEWANYKTTPPVLDSDGS FFLYSKLTVTKEEWQQGFVFSCSVMHEALHNHYTQKSLSLSPGK | ch1C7.HC.CH3C.35. 23.2 |
| 416 | EVKLVESGGGLVKPGGSLKLSCAASGFTFSSYGMSWVRQTPEKRLEWVA SISGDGGSYIHYADSVKGRFTISRDSAKNTLYLQMSSLRSEDTALYYCARL PYWGQGTLVTVSAASTKGPSVFPLAPSSKSTSGGTAALGCLVKDYFPEPV TVSWNSGALTSGVHTFPAVLQSSGLYSLSSVVTVPSSSLGTQTYICNVNH KPSNTKVDKKVEPKSCDKTHTCPPCPAPELLGGPSVFLFPPKPKDTLMISR TPEVTCVVVDVSHEDPEVKFNWYVDGVEVHNAKTKPREEQYNSTYRVV SVLTVLHQDWLNGKEYKCKVSNKALPAPIEKTISKAKGQPREPQVYTLPP SRDELTKNQVSLTCLVKGFYPSDIAVEWESYGTEWVNYKTTPPVLDSDGS FFLYSKLTVTKEEWQQGFVFSCSVMHEALHNHYTQKSLSLSPGK | ch1C7.HC.CH3C.35. 23.3 |
| 417 | EVKLVESGGGLVKPGGSLKLSCAASGFTFSSYGMSWVRQTPEKRLEWVA SISGDGGSYIHYADSVKGRFTISRDSAKNTLYLQMSSLRSEDTALYYCARL PYWGQGTLVTVSAASTKGPSVFPLAPSSKSTSGGTAALGCLVKDYFPEPV TVSWNSGALTSGVHTFPAVLQSSGLYSLSSVVTVPSSSLGTQTYICNVNH KPSNTKVDKKVEPKSCDKTHTCPPCPAPELLGGPSVFLFPPKPKDTLMISR TPEVTCVVVDVSHEDPEVKFNWYVDGVEVHNAKTKPREEQYNSTYRVV SVLTVLHQDWLNGKEYKCKVSNKALPAPIEKTISKAKGQPREPQVYTLPP SRDELTKNQVSLTCLVKGFYPSDIAVEWESYGTEWSNYKTTPPVLDSDGS FFLYSKLTVSKEEWQQGFVFSCSVMHEALHNHYTQKSLSLSPGK | ch1C7.HC.CH3C.35. 23.4 |
| 418 | EVKLVESGGGLVKPGGSLKLSCAASGFTFSSYGMSWVRQTPEKRLEWVA SISGDGGSYIHYADSVKGRFTISRDSAKNTLYLQMSSLRSEDTALYYCARL PYWGQGTLVTVSAASTKGPSVFPLAPSSKSTSGGTAALGCLVKDYFPEPV TVSWNSGALTSGVHTFPAVLQSSGLYSLSSVVTVPSSSLGTQTYICNVNH KPSNTKVDKKVEPKSCDKTHTCPPCPAPELLGGPSVFLFPPKPKDTLMISR TPEVTCVVVDVSHEDPEVKFNWYVDGVEVHNAKTKPREEQYNSTYRVV SVLTVLHQDWLNGKEYKCKVSNKALPAPIEKTISKAKGQPREPQVYTLPP SRDELTKNQVSLTCLVKGFYPSDIAVLWESYGTEWASYKTTPPVLDSDGS FFLYSKLTVTKEEWQQGFVFSCSVMHEALHNHYTQKSLSLSPGK | ch1C7.HC.CH3C.35. |
| 419 | EVKLVESGGGLVKPGGSLKLSCAASGFTFSSYGMSWVRQTPEKRLEWVA SISGDGGSYIHYADSVKGRFTISRDSAKNTLYLQMSSLRSEDTALYYCARL PYWGQGTLVTVSAASTKGPSVFPLAPSSKSTSGGTAALGCLVKDYFPEPV TVSWNSGALTSGVHTFPAVLQSSGLYSLSSVVTVPSSSLGTQTYICNVNH KPSNTKVDKKVEPKSCDKTHTCPPCPAPELLGGPSVFLFPPKPKDTLMISR TPEVTCVVVDVSHEDPEVKFNWYVDGVEVHNAKTKPREEQYNSTYRVV SVLTVLHQDWLNGKEYKCKVSNKALPAPIEKTISKAKGQPREPQVYTLPP SRDELTKNQVSLTCLVKGFYPSDIAVEWESYGTEWSNYKTTPPVLDSDGS FFLYSKLTVTKEEWQQGFVFSCSVMHEALHNHYTQKSLSLSPGK | ch1C7.HC.CH3C.35. 23 |
| 420 | GFTFSRVGVS | Affinity matured variant hu1C7.v2 CDR-H1_1-1 |
| 421 | GFKFSSVGVS | Affinity matured variant hu1C7.v2 CDR-H1_1-2 |
| 422 | GFKFSQVGVS | Affinity matured variant hu1C7.v2 CDR-H1_1-3 |

| INFORMAL SEQUENCE LISTING | | |
|---|---|---|
| SEQ ID NO | Sequence | Description |
| 423 | GFKFSMVGVS | Affinity matured variant hu1C7.v2 CDR-H1_1-4 |
| 424 | GFKFSRYGVS | Affinity matured variant hu1C7.v2 CDR-H1_1-5 |
| 425 | GFKFSRVGMS | Affinity matured variant hu1C7.v2 CDR-H1_1-6 |
| 426 | GFTFSSVGTS | Affinity matured variant hu1C7.v2 CDR-H1_2-1 |
| 427 | GFTFSMVGTS | Affinity matured variant hu1C7.v2 CDR-H1_2-2 |
| 428 | GFTFSQVGTS | Affinity matured variant hu1C7.v2 CDR-H1_2-3 |
| 429 | GFTFSLVGTS | Affinity matured variant hu1C7.v2 CDR-H1_2-4 |
| 430 | GFTFSKVGTS | Affinity matured variant hu1C7.v2 CDR-H1_2-5 |
| 431 | GFTFSRYGTS | Affinity matured variant hu1C7.v2 CDR-H1_2-6 |
| 432 | GFTFSRVGMS | Affinity matured variant hu1C7.v2 CDR-H1_2-7 |
| 433 | GFTFSGPGMS | Affinity matured variant hu1C7.v2 CDR-H1_4-1 |
| 434 | GFQFSGPGMS | Affinity matured variant hu1C7.v2 CDR-H1_4-2 |
| 435 | GFMFSGPGMS | Affinity matured variant hu1C7.v2 CDR-H1_4-3 |
| 436 | GFRFSSPGMS | Affinity matured variant hu1C7.v2 CDR-H1_4-4 |
| 437 | GFRFSGYGMS | Affinity matured variant hu1C7.v2 CDR-H1_4-5 |
| 438 | SISGEGGSYIHYADSVK | Affinity matured variant hu1C7.v2 CDR-H2_1 |
| 439 | SISGTGGSYIHYADSVK | Affinity matured variant hu1C7.v2 CDR-H2_2 |
| 440 | SISGSGGSYIHYADSVK | Affinity matured variant hu1C7.v2 CDR-H2_3 |

| INFORMAL SEQUENCE LISTING | | |
|---|---|---|
| SEQ ID NO | Sequence | Description |
| 441 | SISGDAGSYIHYADSVK | Affinity matured variant hu1C7.v2 CDR-H2_4 |
| 442 | SISGDGGSYIHYASSVK | Affinity matured variant hu1C7.v2 CDR-H2_5 |
| 443 | SISGDGGSYIHYADAVK | Affinity matured variant hu1C7.v2 CDR-H2_6 |
| 444 | KSSQSLLYSGNQKNYLT | Affinity matured variant hu1C7.v2 CDR-L1_4 |
| 445 | KSSQSLLSSGNQKNYLT | Affinity matured variant hu1C7.v2 CDR-L1_5 |
| 446 | KSSQSLLQSGNQKNYLT | Affinity matured variant hu1C7.v2 CDR-L1_6 |
| 447 | KSSQSLLNAGNQKNYLT | Affinity matured variant hu1C7.v2 CDR-L1_7 |
| 448 | KSSQSLVRSGTQKDYLV | Affinity matured variant hu1C7.v2 CDR-L1_3-1 |
| 449 | KSSQSLLRSGTQKDYLV | Affinity matured variant hu1C7.v2 CDR-L1_3-2 |
| 450 | KSSQSLHYSGTQKDYLV | Affinity matured variant hu1C7.v2 CDR-L1_3-3 hu1C7.v2-1CDR-L1 |
| 451 | KSSQSLHNSGTQKDYLV | Affinity matured variant hu1C7.v2 CDR-L1_3-4 |
| 452 | KSSQSLHMSGTQKDYLV | Affinity matured variant hu1C7.v2 CDR-L1_3-5 |
| 453 | KSSQSLHQSGTQKDYLV | Affinity matured variant hu1C7.v2 CDR-L1_3-6 |
| 454 | KSSQSLHKSGTQKDYLV | Affinity matured variant hu1C7.v2 CDR-L1_3-7 |
| 455 | KSSQSLHLSGTQKDYLV | Affinity matured variant hu1C7.v2 CDR-L1_3-8 |
| 456 | KSSQSLHRSGNQKDYLV | Affinity matured variant hu1C7.v2 CDR-L1_3-9 |
| 457 | KSSQSLHRSGTQKNYLV | Affinity matured variant hu1C7.v2 CDR-L1_3-10 |
| 458 | KSSQSLHRSGTQKDYLA | Affinity matured variant hu1C7.v2 CDR-L1_3-11 |

| INFORMAL SEQUENCE LISTING | | |
|---|---|---|
| SEQ ID NO | Sequence | Description |
| 459 | KSSQSLLYSGNQKDYLV | Affinity matured variant hu1C7.v2 CDR-L1_3-12 hu1C7.v2-2 CDR-L1 |
| 460 | QQYYSYPLT | Affinity matured variant hu1C7.v2 CDR-L3_5 |
| 461 | QQYSSYPLT | Affinity matured variant hu1C7.v2 CDR-L3_6 hu1C7.v2-1 CDR-L3 hu1C7.v2-2 CDR-L3 |
| 462 | QQYNAYPLT | Affinity matured variant hu1C7.v2 CDR-L3_7 |
| 463 | DIVMTQSPDSLAVSLGERATINCKSSQSLHYSGTQKDYLVWYQQKPGQPP KLLIYWASTRESGVPDRFSGSGSGTDFTLTISSLQAEDVAVYYCQQYSYP LTFGQGTKVEIK | hu1C7.v2-1 VL 1C7_Lv8 |
| 464 | DIVMTQSPDSLAVSLGERATINCKSSQSLLYSGNQKDYLVWYQQKPGQPP KLLIYWASTRESGVPDRFSGSGSGTDFTLTISSLQAEDVAVYYCQQYSSYP LTFGQGTKVEIK | hu1C7.v2-2 VL |
| 465 | GFX$_1$FSX$_2$X$_3$GX$_4$S, wherein X$_1$ is T, K, R, Q, or M; X$_2$ is S, R, Q, M, L, K, G, or, S; X$_3$ is Y, V, or P; and X$_4$ is M, V, or T | hu1C7.v2-like CDR-H1 consensus_2 |
| 466 | SISGX$_1$X$_2$GSYIHYAX$_3$X$_4$VK, wherein X$_1$ is D, E, T, or S; X$_2$ is G or A; X$_3$ is D or S; and X$_4$ is S or A | hu1C7.v2-like CDR-H2 consensus_1 |
| 467 | KSSQSLX$_1$X$_2$X$_3$GX$_4$QKX$_5$YLX$_6$, wherein X$_1$ is L, H, or V; X$_2$ is N, Y, S, Q, R, M, K, or L; X$_3$ is S or A; X$_4$ is T or N; X$_5$ is N or D; X$_6$ is T, V, or A | hu1C7.v2-like CDR-L1 consensus_2 |
| 468 | QQYX$_1$X$_2$YPLT, wherein X$_1$ is N, Y, or S; X$_2$ is S or A | hu1C7.v2-like CDR-L3 consensus_2 |
| 469 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESFGTEWSSYKTTPPVLDSDGSFFLYSKLTVSKEEWQQGFVFSCSVMHE ALHNHYTQKSLSLSPGK | Clone CH3C.35.20.1.1 |
| 470 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESYGTEWANYKTTPPVLDSDGSFFLYSKLTVSKSEWQQGFVFSCSVMH EALHNHYTQKSLSLSPGK | Clone CH3C.35.23.2.1 |
| 471 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESFGTEWSNYKTTPPVLDSDGSFFLYSKLTVSKEEWQQGFVFSCSVMH EALHNHYTQKSLSLSPGK | Clone CH3C.35.23.1.1 |
| 472 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESYGTEWSSYKTTPPVLDSDGSFFLYSKLTVSKSEWQQGFVFSCSVMHE ALHNHYTQKSLSLSPGK | Clone CH3C.35.S413 |
| 473 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESYGTEWVNYKTTPPVLDSDGSFFLYSKLTVSKEEWQQGFVFSCSVMH EALHNHYTQKSLSLSPGK | Clone CH3C.35.23.3.1 |

-continued

INFORMAL SEQUENCE LISTING

| SEQ ID NO | Sequence | Description |
|---|---|---|
| 474 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESYGTEWSNYKTTPPVLDSDGSFFLYSKLTVSKSEWQQGFVFSCSVMH EALHNHYTQKSLSLSPGK | Clone CH3C.35.N390.1 |
| 475 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESFGTEWVNYKTTPPVLDSDGSFFLYSKLTVSKEEWQQGFVFSCSVMH EALHNHYTQKSLSLSPGK | Clone CH3C.35.23.6.1 |
| 476 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV WWESYGTEWSSYKTTPPVLDSDGSFFLYSKLTVTKEEWQQGFVFSCSVM HEALHNHYTQKSLSLSPGK | Clone CH3C.35.21 with knob and LALAPG mutations |
| 477 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV WWESYGTEWSSYKTTPPVLDSDGSFFLYSKLTVTKEEWQQGFVFSCSVM HEALHNHYTQKSLSLSPGK | Clone CH3C.35.21 with knob, LALAPG, and YTE mutations |
| 478 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV WWESYGTEWSSYKTTPPVLDSDGSFFLYSKLTVTKEEWQQGFVFSCSVM HEALHNHYTQKSLSLSPGK | Clone CH3C.35.21 with hole and LALAPG mutations |
| 479 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV WWESYGTEWSSYKTTPPVLDSDGSFFLYSKLTVTKEEWQQGFVFSCSVM HEALHNHYTQKSLSLSPGK | Clone CH3C.35.21 with hole, LALAPG, and YTE mutations |
| 480 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESFGTEWSSYKTTPPVLDSDGSFFLYSKLTVSKEEWQQGFVFSCSVMH EALHNHYTQKSLSLSPGK | Clone CH3C.35.20.1.1 with knob mutation |
| 481 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESFGTEWSSYKTTPPVLDSDGSFFLYSKLTVSKEEWQQGFVFSCSVMH EALHNHYTQKSLSLSPGK | Clone CH3C.35.20.1.1 with knob and LALA mutations |
| 482 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV EWESFGTEWSSYKTTPPVLDSDGSFFLYSKLTVSKEEWQQGFVFSCSVMH EALHNHYTQKSLSLSPGK | Clone CH3C.35.20.1.1 with knob and LALAPG mutations |
| 483 | APELLGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESFGTEWSSYKTTPPVLDSDGSFFLYSKLTVSKEEWQQGFVFSCSVMH EALHNHYTQKSLSLSPGK | Clone CH3C.35.20.1.1 with knob and YTE mutations |
| 484 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESFGTEWSSYKTTPPVLDSDGSFFLYSKLTVSKEEWQQGFVFSCSVMH EALHNHYTQKSLSLSPGK | Clone CH3C.35.20.1.1 with knob LALA and YTE mutations |
| 485 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV EWESFGTEWSSYKTTPPVLDSDGSFFLYSKLTVSKEEWQQGFVFSCSVMH EALHNHYTQKSLSLSPGK | Clone CH3C.35.20.1.1 with knob LALAPG and YTE mutations |

| INFORMAL SEQUENCE LISTING | | |
|---|---|---|
| SEQ ID NO | Sequence | Description |
| 486 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESFGTEWSSYKTTPPVLDSDGSFFLVSKLTVSKEEWQQGFVFSCSVMHE ALHNHYTQKSLSLSPGK | Clone CH3C.35.20.1.1 with hole mutations |
| 487 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESFGTEWSSYKTTPPVLDSDGSFFLVSKLTVSKEEWQQGFVFSCSVMHE ALHNHYTQKSLSLSPGK | Clone CH3C.35.20.1.1 with hole and LALA mutations |
| 488 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV EWESFGTEWSSYKTTPPVLDSDGSFFLVSKLTVSKEEWQQGFVFSCSVMH EALHNHYTQKSLSLSPGK | Clone CH3C.35.20.1.1 with hole and LALAPG mutations |
| 489 | APELLGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESFGTEWSSYKTTPPVLDSDGSFFLVSKLTVSKEEWQQGFVFSCSVMHE ALHNHYTQKSLSLSPGK | Clone CH3C.35.20.1.1 with hole and YTE mutations |
| 490 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESFGTEWSSYKTTPPVLDSDGSFFLVSKLTVSKEEWQQGFVFSCSVMHE ALHNHYTQKSLSLSPGK | Clone CH3C.35.20.1.1 with hole LALA and YTE mutations |
| 491 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV EWESFGTEWSSYKTTPPVLDSDGSFFLVSKLTVSKEEWQQGFVFSCSVMH EALHNHYTQKSLSLSPGK | Clone CH3C.35.20.1.1 with hole LALAPG and YTE mutations |
| 492 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESYGTEWANYKTTPPVLDSDGSFFLYSKLTVSKSEWQQGFVFSCSVM HEALHNHYTQKSLSLSPGK | Clone CH3C.35.23.2.1 with knob mutation |
| 493 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESYGTEWANYKTTPPVLDSDGSFFLYSKLTVSKSEWQQGFVFSCSVM HEALHNHYTQKSLSLSPGK | Clone CH3C.35.23.2.1 with knob and LALA mutations |
| 494 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV EWESYGTEWANYKTTPPVLDSDGSFFLYSKLTVSKSEWQQGFVFSCSVM HEALHNHYTQKSLSLSPGK | Clone CH3C.35.23.2.1 with knob and LALAPG mutations |
| 495 | APELLGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESYGTEWANYKTTPPVLDSDGSFFLYSKLTVSKSEWQQGFVFSCSVM HEALHNHYTQKSLSLSPGK | Clone CH3C.35.23.2.1 with knob and YTE mutations |
| 496 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESYGTEWANYKTTPPVLDSDGSFFLYSKLTVSKSEWQQGFVFSCSVM HEALHNHYTQKSLSLSPGK | Clone CH3C.35.23.2.1 with knob, LALA, and YTE mutations |
| 497 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV EWESYGTEWANYKTTPPVLDSDGSFFLYSKLTVSKSEWQQGFVFSCSVM HEALHNHYTQKSLSLSPGK | Clone CH3C.35.23.2.1 with knob, LALAPG, and YTE mutations |

INFORMAL SEQUENCE LISTING

| SEQ ID NO | Sequence | Description |
|---|---|---|
| 498 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLSCAVKGFYPSDIAVE<br>WESYGTEWANYKTTPPVLDSDGSFFLVSKLTVSKSEWQQGFVFSCSVMH<br>EALHNHYTQKSLSLSPGK | Clone CH3C.35.23.2.1 with hole mutations |
| 499 | APEAAGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLSCAVKGFYPSDIAVE<br>WESYGTEWANYKTTPPVLDSDGSFFLVSKLTVSKSEWQQGFVFSCSVMH<br>EALHNHYTQKSLSLSPGK | Clone CH3C.35.23.2.1 with hole and LALA mutations |
| 500 | APEAAGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>GAPIEKTISKAKGQPREPQVYTLPPSRDELTKNQVSLSCAVKGFYPSDIAV<br>EWESYGTEWANYKTTPPVLDSDGSFFLVSKLTVSKSEWQQGFVFSCSVM<br>HEALHNHYTQKSLSLSPGK | Clone CH3C.35.23.2.1 with hole and LALAPG mutations |
| 501 | APELLGGPSVFLFPPKPKDTLYITREPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLSCAVKGFYPSDIAVE<br>WESYGTEWANYKTTPPVLDSDGSFFLVSKLTVSKSEWQQGFVFSCSVMH<br>EALHNHYTQKSLSLSPGK | Clone CH3C.35.23.2.1 with hole and YTE mutations |
| 502 | APEAAGGPSVFLFPPKPKDTLYITREPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLSCAVKGFYPSDIAVE<br>WESYGTEWANYKTTPPVLDSDGSFFLVSKLTVSKSEWQQGFVFSCSVMH<br>EALHNHYTQKSLSLSPGK | Clone CH3C.35.23.2.1 with hole, LALA, and YTE mutations |
| 503 | APEAAGGPSVFLFPPKPKDTLYITREPEVTCVVVDVSHEDPEVKFNWYVD<br>GVEVHNAKTKPREEQYNSTYRVVSVLTVLHQDWLNGKEYKCKVSNKAL<br>GAPIEKTISKAKGQPREPQVYTLPPSRDELTKNQVSLSCAVKGFYPSDIAV<br>EWESYGTEWANYKTTPPVLDSDGSFFLVSKLTVSKSEWQQGFVFSCSVM<br>HEALHNHYTQKSLSLSPGK | Clone CH3C.35.23.2.1 with hole, LALAPG, and YTE mutations |
| 504 | APELLGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLWCLVKGFYPSDIAV<br>EWESFGTEWSNYKTTPPVLDSDGSFFLYSKLTVSKEEWQQGFVFSCSVM<br>HEALHNHYTQKSLSLSPGK | Clone CH3C.35.23.1.1 with knob mutation |
| 505 | APEAAGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLWCLVKGFYPSDIAV<br>EWESFGTEWSNYKTTPPVLDSDGSFFLYSKLTVSKEEWQQGFVFSCSVM<br>HEALHNHYTQKSLSLSPGK | Clone CH3C.35.23.1.1 with knob and LALA mutations |
| 506 | APEAAGGPSVFLFPPKPKDTLMISRTPEVTCVVVDVSHEDPEVKFNWYVD<br>GVEVHNAKTKPREEQYNSTYRVVSVLTVLHQDWLNGKEYKCKVSNKAL<br>GAPIEKTISKAKGQPREPQVYTLPPSRDELTKNQVSLWCLVKGFYPSDIAV<br>EWESFGTEWSNYKTTPPVLDSDGSFFLYSKLTVSKEEWQQGFVFSCSVM<br>HEALHNHYTQKSLSLSPGK | Clone CH3C.35.23.1.1 with knob and LALAPG mutations |
| 507 | APELLGGPSVFLFPPKPKDTLYITREPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLWCLVKGFYPSDIAV<br>EWESFGTEWSNYKTTPPVLDSDGSFFLYSKLTVSKEEWQQGFVFSCSVM<br>HEALHNHYTQKSLSLSPGK | Clone CH3C.35.23.1.1 with knob and YTE mutations |
| 508 | APEAAGGPSVFLFPPKPKDTLYITREPEVTCVVVDVSHEDPEVKFNWYVD<br>GVEVHNAKTKPREEQYNSTYRVVSVLTVLHQDWLNGKEYKCKVSNKAL<br>PAPIEKTISKAKGQPREPQVYTLPPSRDELTKNQVSLWCLVKGFYPSDIAV<br>EWESFGTEWSNYKTTPPVLDSDGSFFLYSKLTVSKEEWQQGFVFSCSVM<br>HEALHNHYTQKSLSLSPGK | Clone CH3C.35.23.1.1 with knob, LALA, and YTE mutations |
| 509 | APEAAGGPSVFLFPPKPKDTLYITREPEVTCVVVDVSHEDPEVKFNWYVD<br>GVEVHNAKTKPREEQYNSTYRVVSVLTVLHQDWLNGKEYKCKVSNKAL<br>GAPIEKTISKAKGQPREPQVYTLPPSRDELTKNQVSLWCLVKGFYPSDIAV<br>EWESFGTEWSNYKTTPPVLDSDGSFFLYSKLTVSKEEWQQGFVFSCSVM<br>HEALHNHYTQKSLSLSPGK | Clone CH3C.35.23.1.1 with knob, LALAPG, and YTE mutations |

| SEQ ID NO | Sequence | Description |
|---|---|---|
| 510 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESFGTEWSNYKTTPPVLDSDGSFFLVSKLTVSKEEWQQGFVFSCSVMH EALHNHYTQKSLSLSPGK | Clone CH3C.35.23.1.1 with hole mutations |
| 511 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESFGTEWSNYKTTPPVLDSDGSFFLVSKLTVSKEEWQQGFVFSCSVMH EALHNHYTQKSLSLSPGK | Clone CH3C.35.23.1.1 with hole and LALA mutations |
| 512 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV EWESFGTEWSNYKTTPPVLDSDGSFFLVSKLTVSKEEWQQGFVFSCSVM HEALHNHYTQKSLSLSPGK | Clone CH3C.35.23.1.1 with hole and LALAPG mutations |
| 513 | APELLGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESFGTEWSNYKTTPPVLDSDGSFFLVSKLTVSKEEWQQGFVFSCSVMH EALHNHYTQKSLSLSPGK | Clone CH3C.35.23.1.1 with hole and YTE mutations |
| 514 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESFGTEWSNYKTTPPVLDSDGSFFLVSKLTVSKEEWQQGFVFSCSVMH EALHNHYTQKSLSLSPGK | Clone CH3C.35.23.1.1 with hole, LALA, and YTE mutations |
| 515 | APEAAGGPSVFLFPPKPKDTLYITREPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV EWESFGTEWSNYKTTPPVLDSDGSFFLVSKLTVSKEEWQQGFVFSCSVM HEALHNHYTQKSLSLSPGK | Clone CH3C.35.23.1.1 with hole, LALAPG, and YTE mutations |
| 516 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESFGTEWSSYKTTPPVLDSDGSFFLYSKLTVTKEEWQQGFVFSCSVLHE ALHSHYTQKSLSLSPGK | Clone CH3C.35.20.1 M198L and N204S mutations |
| 517 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESFGTEWSSYKTTPPVLDSDGSFFLYSKLTVTKEEWQQGFVFSCSVLH EALHSHYTQKSLSLSPGK | Clone CH3C.35.20.1 with knob and M198L and N204S mutations |
| 518 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESFGTEWSSYKTTPPVLDSDGSFFLYSKLTVTKEEWQQGFVFSCSVLH EALHSHYTQKSLSLSPGK | Clone CH3C.35.20.1 with knob, LALA, and M198L and N204S mutations |
| 519 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV EWESFGTEWSSYKTTPPVLDSDGSFFLYSKLTVTKEEWQQGFVFSCSVLH EALHSHYTQKSLSLSPGK | Clone CH3C.35.20.1 with knob, LALAPG, and M198L and N204S mutations |
| 520 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESFGTEWSSYKTTPPVLDSDGSFFLVSKLTVTKEEWQQGFVFSCSVLHE ALHSHYTQKSLSLSPGK | Clone CH3C.35.20.1 with hole and M198L and N204S mutations |
| 521 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESFGTEWSSYKTTPPVLDSDGSFFLVSKLTVTKEEWQQGFVFSCSVLHE ALHSHYTQKSLSLSPGK | Clone CH3C.35.20.1 with hole, LALA, and M198L and N204S mutations |

| SEQ ID NO | Sequence | Description |
|---|---|---|
| 522 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV EWESFGTEWSSYKTTPPVLDSDGSFFLVSKLTVTKEEWQQGFVFSCSVLH EALHSHYTQKSLSLSPGK | Clone CH3C.35.20.1 with hole, LALAPG, and M198L and N204S mutations |
| 523 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESYGTEWANYKTTPPVLDSDGSFFLYSKLTVTKEEWQQGFVFSCSVLH EALHSHYTQKSLSLSPGK | Clone CH3C.35.23.2 with M198L and N204S mutations |
| 524 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESYGTEWANYKTTPPVLDSDGSFFLYSKLTVTKEEWQQGFVFSCSVL HEALHSHYTQKSLSLSPGK | Clone CH3C.35.23.2 with knob and M198L and N204S mutations |
| 525 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESYGTEWANYKTTPPVLDSDGSFFLYSKLTVTKEEWQQGFVFSCSVL HEALHSHYTQKSLSLSPGK | Clone CH3C.35.23.2 with knob, LALA, and M198L and N204S mutations |
| 526 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV EWESYGTEWANYKTTPPVLDSDGSFFLYSKLTVTKEEWQQGFVFSCSVL HEALHSHYTQKSLSLSPGK | Clone CH3C.35.23.2 with knob, LALAPG, and M198L and N204S mutations |
| 527 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESYGTEWANYKTTPPVLDSDGSFFLYSKLTVTKEEWQQGFVFSCSVLH EALHSHYTQKSLSLSPGK | Clone CH3C.35.23.2 with hole and M198L and N204S mutations |
| 528 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESYGTEWANYKTTPPVLDSDGSFFLYSKLTVTKEEWQQGFVFSCSVLH EALHSHYTQKSLSLSPGK | Clone CH3C.35.23.2 with hole, LALA, and M198L and N204S mutations |
| 529 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV EWESYGTEWANYKTTPPVLDSDGSFFLYSKLTVTKEEWQQGFVFSCSVL HEALHSHYTQKSLSLSPGK | Clone CH3C.35.23.2 with hole, LALAPG, and M198L and N204S mutations |
| 530 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESYGTEWVNYKTTPPVLDSDGSFFLYSKLTVTKEEWQQGFVFSCSVLH EALHSHYTQKSLSLSPGK | Clone CH3C.35.23.3 with M198L and N204S mutations |
| 531 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESYGTEWVNYKTTPPVLDSDGSFFLYSKLTVTKEEWQQGFVFSCSVL HEALHSHYTQKSLSLSPGK | Clone CH3C.35.23.3 with knob and M198L and N204S mutations |
| 532 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESYGTEWVNYKTTPPVLDSDGSFFLYSKLTVTKEEWQQGFVFSCSVL HEALHSHYTQKSLSLSPGK | Clone CH3C.35.23.3 with knob, LALA, and M198L and N204S mutations |
| 533 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV EWESYGTEWVNYKTTPPVLDSDGSFFLYSKLTVTKEEWQQGFVFSCSVL HEALHSHYTQKSLSLSPGK | Clone CH3C.35.23.3 with knob, LALAPG, and M198L and N204S mutations |

| SEQ ID NO | Sequence | Description |
|---|---|---|
| 534 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESYGTEWVNYKTTPPVLDSDGSFFLVSKLTVTKEEWQQGFVFSCSVLH EALHSHYTQKSLSLSPGK | Clone CH3C.35.23.3 with hole and M198L and N204S mutations |
| 535 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESYGTEWVNYKTTPPVLDSDGSFFLVSKLTVTKEEWQQGFVFSCSVLH EALHSHYTQKSLSLSPGK | Clone CH3C.35.23.3 with hole, LALA, and M198L and N204S mutations |
| 536 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV EWESYGTEWVNYKTTPPVLDSDGSFFLVSKLTVTKEEWQQGFVFSCSVL HEALHSHYTQKSLSLSPGK | Clone CH3C.35.23.3 with hole, LALAPG, and M198L and N204S mutations |
| 537 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESYGTEWSNYKTTPPVLDSDGSFFLYSKLTVSKEEWQQGFVFSCSVLHE ALHSHYTQKSLSLSPGK | Clone CH3C.35.23.4 with M198L and N204S mutations |
| 538 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESYGTEWSNYKTTPPVLDSDGSFFLYSKLTVSKEEWQQGFVFSCSVLH EALHSHYTQKSLSLSPGK | Clone CH3C.35.23.4 with knob and M198L and N204S mutations |
| 539 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESYGTEWSNYKTTPPVLDSDGSFFLYSKLTVSKEEWQQGFVFSCSVLH EALHSHYTQKSLSLSPGK | Clone CH3C.35.23.4 with knob, LALA, and M198L and N204S mutations |
| 540 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV EWESYGTEWSNYKTTPPVLDSDGSFFLYSKLTVSKEEWQQGFVFSCSVLH EALHSHYTQKSLSLSPGK | Clone CH3C.35.23.4 with knob, LALAPG, and M198L and N204S mutations |
| 541 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESYGTEWSNYKTTPPVLDSDGSFFLVSKLTVSKEEWQQGFVFSCSVLHE ALHSHYTQKSLSLSPGK | Clone CH3C.35.23.4 with hole and M198L and N204S mutations |
| 542 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESYGTEWSNYKTTPPVLDSDGSFFLVSKLTVSKEEWQQGFVFSCSVLHE ALHSHYTQKSLSLSPGK | Clone CH3C.35.23.4 with hole, LALA, and M198L and N204S mutations |
| 543 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV EWESYGTEWSNYKTTPPVLDSDGSFFLVSKLTVSKEEWQQGFVFSCSVLH EALHSHYTQKSLSLSPGK | Clone CH3C.35.23.4 with hole, LALAPG, and M198L and N204S mutations |
| 544 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVL WESYGTEWASYKTTPPVLDSDGSFFLYSKLTVTKEEWQQGFVFSCSVLHE ALHSHYTQKSLSLSPGK | Clone CH3C.35.21.17.2 with M198L and N204S mutations |
| 545 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV LWESYGTEWASYKTTPPVLDSDGSFFLYSKLTVTKEEWQQGFVFSCSVLH EALHSHYTQKSLSLSPGK | Clone CH3C.35.21.17.2 with knob and M198L and N204S mutations |

| SEQ ID NO | Sequence | Description |
|---|---|---|
| 546 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV LWESYGTEWASYKTTPPVLDSDGSFFLYSKLTVTKEEWQQGFVFSCSVLH EALHSHYTQKSLSLSPGK | Clone CH3C.35.21.17.2 with knob, LALA, and M198L and N204S mutations |
| 547 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV LWESYGTEWASYKTTPPVLDSDGSFFLYSKLTVTKEEWQQGFVFSCSVLH EALHSHYTQKSLSLSPGK | Clone CH3C.35.21.17.2 with knob, LALAPG, and M198L and N204S mutations |
| 548 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVL WESYGTEWASYKTTPPVLDSDGSFFLVSKLTVTKEEWQQGFVFSCSVLHE ALHSHYTQKSLSLSPGK | Clone CH3C.35.21.17.2 with hole and M198L and N204S mutations |
| 549 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVL WESYGTEWASYKTTPPVLDSDGSFFLVSKLTVTKEEWQQGFVFSCSVLHE ALHSHYTQKSLSLSPGK | Clone CH3C.35.21.17.2 with hole, LALA, and M198L and N204S mutations |
| 550 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV LWESYGTEWASYKTTPPVLDSDGSFFLVSKLTVTKEEWQQGFVFSCSVLH EALHSHYTQKSLSLSPGK | Clone CH3C.35.21.17.2 with hole, LALAPG, and M198L and N204S mutations |
| 551 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESYGTEWSNYKTTPPVLDSDGSFFLYSKLTVTKEEWQQGFVFSCSVLHE ALHSHYTQKSLSLSPGK | Clone CH3C.35.23 with M198L and N204S mutations |
| 552 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESYGTEWSNYKTTPPVLDSDGSFFLYSKLTVTKEEWQQGFVFSCSVLH EALHSHYTQKSLSLSPGK | Clone CH3C.35.23 with knob and M198L and N204S mutations |
| 553 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESYGTEWSNYKTTPPVLDSDGSFFLYSKLTVTKEEWQQGFVFSCSVLH EALHSHYTQKSLSLSPGK | Clone CH3C.35.23 with knob, LALA, and M198L and N204S mutations |
| 554 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV EWESYGTEWSNYKTTPPVLDSDGSFFLYSKLTVTKEEWQQGFVFSCSVLH EALHSHYTQKSLSLSPGK | Clone CH3C.35.23 with knob, LALAPG, and M198L and N204S mutations |
| 555 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESYGTEWSNYKTTPPVLDSDGSFFLVSKLTVTKEEWQQGFVFSCSVLHE ALHSHYTQKSLSLSPGK | Clone CH3C.35.23 with hole and M198L and N204S mutations |
| 556 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESYGTEWSNYKTTPPVLDSDGSFFLVSKLTVTKEEWQQGFVFSCSVLHE ALHSHYTQKSLSLSPGK | Clone CH3C.35.23 with hole, LALA, and M198L and N204S mutations |
| 557 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV EWESYGTEWSNYKTTPPVLDSDGSFFLVSKLTVTKEEWQQGFVFSCSVLH EALHSHYTQKSLSLSPGK | Clone CH3C.35.23 with hole, LALAPG, and M198L and N204S mutations |

| SEQ ID NO | Sequence | Description |
|---|---|---|
| 558 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAV WWESYGTEWSSYKTTPPVLDSDGSFFLYSKLTVTKEEWQQGFVFSCSVL HEALHSHYTQKSLSLSPGK | Clone CH3C.35.21 with M198L and N204S mutations |
| 559 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV WWESYGTEWSSYKTTPPVLDSDGSFFLYSKLTVTKEEWQQGFVFSCSVL HEALHSHYTQKSLSLSPGK | Clone CH3C.35.21 with knob and M198L and N204S mutations |
| 560 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV WWESYGTEWSSYKTTPPVLDSDGSFFLYSKLTVTKEEWQQGFVFSCSVL HEALHSHYTQKSLSLSPGK | Clone CH3C.35.21 with knob, LALA, and M198L and N204S mutations |
| 561 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV WWESYGTEWSSYKTTPPVLDSDGSFFLYSKLTVTKEEWQQGFVFSCSVL HEALHSHYTQKSLSLSPGK | Clone CH3C.35.21 with knob, LALAPG, and M198L and N204S mutations |
| 562 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAV WWESYGTEWSSYKTTPPVLDSDGSFFLYSKLTVTKEEWQQGFVFSCSVL HEALHSHYTQKSLSLSPGK | Clone CH3C.35.21 with hole and M198L and N204S mutations |
| 563 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAV WWESYGTEWSSYKTTPPVLDSDGSFFLYSKLTVTKEEWQQGFVFSCSVL HEALHSHYTQKSLSLSPGK | Clone CH3C.35.21 with hole, LALA, and M198L and N204S mutations |
| 564 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV WWESYGTEWSSYKTTPPVLDSDGSFFLYSKLTVTKEEWQQGFVFSCSVL HEALHSHYTQKSLSLSPGK | Clone CH3C.35.21 with hole, LALAPG, and M198L and N204S mutations |
| 565 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESFGTEWSSYKTTPPVLDSDGSFFLYSKLTVSKEEWQQGFVFSCSVLHE ALHSHYTQKSLSLSPGK | Clone CH3C.35.20.1.1 with M198L and N204S mutations |
| 566 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESFGTEWSSYKTTPPVLDSDGSFFLYSKLTVSKEEWQQGFVFSCSVLH EALHSHYTQKSLSLSPGK | Clone CH3C.35.20.1.1 with knob and M198L and N204S mutations |
| 567 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESFGTEWSSYKTTPPVLDSDGSFFLYSKLTVSKEEWQQGFVFSCSVLH EALHSHYTQKSLSLSPGK | Clone CH3C.35.20.1.1 with knob, LALA, and M198L and N204S mutations |
| 568 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV EWESFGTEWSSYKTTPPVLDSDGSFFLYSKLTVSKEEWQQGFVFSCSVLH EALHSHYTQKSLSLSPGK | Clone CH3C.35.20.1.1 with knob, LALAPG, and M198L and N204S mutations |
| 569 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESFGTEWSSYKTTPPVLDSDGSFFLYSKLTVSKEEWQQGFVFSCSVLHE ALHSHYTQKSLSLSPGK | Clone CH3C.35.20.1.1 with hole and M198L and N204S mutations |

US 11,370,832 B2

| INFORMAL SEQUENCE LISTING | | |
|---|---|---|
| SEQ ID NO | Sequence | Description |
| 570 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESFGTEWSSYKTTPPVLDSDGSFFLVSKLTVSKEEWQQGFVFSCSVLHE ALHSHYTQKSLSLSPGK | Clone CH3C.35.20.1.1 with hole, LALA, and M198L and N204S mutations |
| 571 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV EWESFGTEWSSYKTTPPVLDSDGSFFLVSKLTVSKEEWQQGFVFSCSVLH EALHSHYTQKSLSLSPGK | Clone CH3C.35.20.1.1 with hole, LALAPG, and M198L and N204S mutations |
| 572 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESYGTEWANYKTTPPVLDSDGSFFLYSKLTVSKSEWQQGFVFSCSVLH EALHSHYTQKSLSLSPGK | Clone CH3C.35.23.2.1 with M198L and N204S mutations |
| 573 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESYGTEWANYKTTPPVLDSDGSFFLYSKLTVSKSEWQQGFVFSCSVL HEALHSHYTQKSLSLSPGK | Clone CH3C.35.23.2.1 with knob and M198L and N204S mutations |
| 574 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESYGTEWANYKTTPPVLDSDGSFFLYSKLTVSKSEWQQGFVFSCSVL HEALHSHYTQKSLSLSPGK | Clone CH3C.35.23.2.1 with knob, LALA, and M198L and N204S mutations |
| 575 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV EWESYGTEWANYKTTPPVLDSDGSFFLYSKLTVSKSEWQQGFVFSCSVL HEALHSHYTQKSLSLSPGK | Clone CH3C.35.23.2.1 with knob, LALAPG, and M198L and N204S mutations |
| 576 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESYGTEWANYKTTPPVLDSDGSFFLVSKLTVSKSEWQQGFVFSCSVLH EALHSHYTQKSLSLSPGK | Clone CH3C.35.23.2.1 with hole and M198L and N204S mutations |
| 577 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESYGTEWANYKTTPPVLDSDGSFFLVSKLTVSKSEWQQGFVFSCSVLH EALHSHYTQKSLSLSPGK | Clone CH3C.35.23.2.1 with hole, LALA, and M198L and N204S mutations |
| 578 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV EWESYGTEWANYKTTPPVLDSDGSFFLVSKLTVSKSEWQQGFVFSCSVL HEALHSHYTQKSLSLSPGK | Clone CH3C.35.23.2.1 with hole, LALAPG, and M198L and N204S mutations |
| 579 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESFGTEWSNYKTTPPVLDSDGSFFLYSKLTVSKEEWQQGFVFSCSVLHE ALHSHYTQKSLSLSPGK | Clone CH3C.35.23.1.1 with M198L and N204S mutations |
| 580 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESFGTEWSNYKTTPPVLDSDGSFFLYSKLTVSKEEWQQGFVFSCSVLH EALHSHYTQKSLSLSPGK | Clone CH3C.35.23.1.1 with knob and M198L an d N204S mutations |
| 581 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESFGTEWSNYKTTPPVLDSDGSFFLYSKLTVSKEEWQQGFVFSCSVLH EALHSHYTQKSLSLSPGK | Clone CH3C.35.23.1.1 with knob, LALA, and M198L and N204S mutations |

| SEQ ID NO | Sequence | Description |
|---|---|---|
| 582 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV EWESFGTEWSNYKTTPPVLDSDGSFFLYSKLTVSKEEWQQGFVFSCSVLH EALHSHYTQKSLSLSPGK | Clone CH3C.35.23.1.1 with knob, LALAPG, and M198L and N204S mutations |
| 583 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESFGTEWSNYKTTPPVLDSDGSFFLVSKLTVSKEEWQQGFVFSCSVLHE ALHSHYTQKSLSLSPGK | Clone CH3C.35.23.1.1 with hole and M198L and N204S mutations |
| 584 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESFGTEWSNYKTTPPVLDSDGSFFLVSKLTVSKEEWQQGFVFSCSVLHE ALHSHYTQKSLSLSPGK | Clone CH3C.35.23.1.1 with hole, LALA, and M198L and N204S mutations |
| 585 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV EWESFGTEWSNYKTTPPVLDSDGSFFLVSKLTVSKEEWQQGFVFSCSVLH EALHSHYTQKSLSLSPGK | Clone CH3C.35.23.1.1 with hole, LALAPG, and M198L and N204S mutations |
| 586 | GFTFSQVGMS | Affinity matured variant hu1 C7 CDR-H1_HCv2 |
| 587 | GFKFSGPGMS | Affinity matured variant hu1 C7 CDR-H1_HCv5 |
| 588 | SISGDGGSYIHYADSVKG | 1C7 CDR-H2 |
| 589 | EVQLLESGGGLVQPGGSLRLSCAASGFTFSRVGTSWVRQAPGKGLEWVA SISGDGGSYIHYADSVKGRFTISRDNSKNTLYLQMNSLRAEDTAVYYCAR LPYWGQGTLVTVSS | hu1C7_VH_1 |
| 590 | EVQLLESGGGLVQPGGSLRLSCAASGFTFSSVGTSWVRQAPGKGLEWVA SISGDGGSYIHYADSVKGRFTISRDNSKNTLYLQMNSLRAEDTAVYYCAR LPYWGQGTLVTVSS | hu1C7_VH_2 |
| 591 | EVQLLESGGGLVQPGGSLRLSCAASGFTFSMVGTSWVRQAPGKGLEWVA SISGDGGSYIHYADSVKGRFTISRDNSKNTLYLQMNSLRAEDTAVYYCAR LPYWGQGTLVTVSS | hu1C7_VH_3 |
| 592 | EVQLLESGGGLVQPGGSLRLSCAASGFTFSQVGTSWVRQAPGKGLEWVA SISGDGGSYIHYADSVKGRFTISRDNSKNTLYLQMNSLRAEDTAVYYCAR LPYWGQGTLVTVSS | hu1C7_VH_4 |
| 593 | EVQLLESGGGLVQPGGSLRLSCAASGFTFSLVGTSWVRQAPGKGLEWVA SISGDGGSYIHYADSVKGRFTISRDNSKNTLYLQMNSLRAEDTAVYYCAR LPYWGQGTLVTVSS | hu1C7_VH_5 |
| 594 | EVQLLESGGGLVQPGGSLRLSCAASGFTFSKVGTSWVRQAPGKGLEWVA SISGDGGSYIHYADSVKGRFTISRDNSKNTLYLQMNSLRAEDTAVYYCAR LPYWGQGTLVTVSS | hu1C7_VH_6 |
| 595 | EVQLLESGGGLVQPGGSLRLSCAASGFTFSRVGMSWVRQAPGKGLEWVA SISGDGGSYIHYADSVKGRFTISRDNSKNTLYLQMNSLRAEDTAVYYCAR LPYWGQGTLVTVSS | hu1C7_VH_7 |
| 596 | EVQLLESGGGLVQPGGSLRLSCAASGFRFSGPGMSWVRQAPGKGLEWVA SISGDGGSYIHYADSVKGRFTISRDNSKNTLYLQMNSLRAEDTAVYYCAR LPYWGQGTLVTVSS | hu1C7_VH_8 |
| 597 | EVQLLESGGGLVQPGGSLRLSCAASGFTFSGPGMSWVRQAPGKGLEWVA SISGDGGSYIHYADSVKGRFTISRDNSKNTLYLQMNSLRAEDTAVYYCAR LPYWGQGTLVTVSS | hu1C7_VH_9 |
| 598 | EVQLLESGGGLVQPGGSLRLSCAASGFQFSGPGMSWVRQAPGKGLEWVA SISGDGGSYIHYADSVKGRFTISRDNSKNTLYLQMNSLRAEDTAVYYCAR LPYWGQGTLVTVSS | hu1C7_VH_10 |

INFORMAL SEQUENCE LISTING

| SEQ ID NO | Sequence | Description |
|---|---|---|
| 599 | EVQLLESGGGLVQPGGSLRLSCAASGFMFSGPGMSWVRQAPGKGLEWV ASISGDGGSYIHYADSVKGRFTISRDNSKNTLYLQMNSLRAEDTAVYYCA RLPYWGQGTLVTVSS | hu1C7_VH_11 |
| 600 | EVQLLESGGGLVQPGGSLRLSCAASGFRFSSPGMSWVRQAPGKGLEWVA SISGDGGSYIHYADSVKGRFTISRDNSKNTLYLQMNSLRAEDTAVYYCAR LPYWGQGTLVTVSS | hu1C7_VH_12 |
| 601 | EVQLLESGGGLVQPGGSLRLSCAASGFRFSGYGMSWVRQAPGKGLEWV ASISGDGGSYIHYADSVKGRFTISRDNSKNTLYLQMNSLRAEDTAVYYCA RLPYWGQGTLVTVSS | hu1C7_VH_13 |
| 602 | EVQLLESGGGLVQPGGSLRLSCAASGFTFSQVGMSWVRQAPGKGLEWV ASISGDGGSYIHYADSVKGRFTISRDNSKNTLYLQMNSLRAEDTAVYYCA RLPYWGQGTLVTVSS | hu1C7_VH_14 |
| 603 | EVQLLESGGGLVQPGGSLRLSCAASGFKFSGPGMSWVRQAPGKGLEWVA SISGDGGSYIHYADSVKGRFTISRDNSKNTLYLQMNSLRAEDTAVYYCAR LPYWGQGTLVTVSS | hu1C7_VH_15 |
| 604 | DIVMTQSPDSLAVSLGERATINCKSSQSLHRSGTQKDYLVWYQQKPGQPP KLLIYWASTRESGVPDRFSGSGSGTDFTLTISSLQAEDVAVYYCQQYNSYP LTFGQGTKVEIK | hu1C7_VL_1 |
| 605 | DIVMTQSPDSLAVSLGERATINCKSSQSLVRSGTQKDYLVWYQQKPGQPP KLLIYWASTRESGVPDRFSGSGSGTDFTLTISSLQAEDVAVYYCQQYNSYP LTFGQGTKVEIK | hu1C7_VL_2 |
| 606 | DIVMTQSPDSLAVSLGERATINCKSSQSLLRSGTQKDYLVWYQQKPGQPP KLLIYWASTRESGVPDRFSGSGSGTDFTLTISSLQAEDVAVYYCQQYNSYP LTFGQGTKVEIK | hu1C7_VL_3 |
| 607 | DIVMTQSPDSLAVSLGERATINCKSSQSLHYSGTQKDYLVWYQQKPGQPP KLLIYWASTRESGVPDRFSGSGSGTDFTLTISSLQAEDVAVYYCQQYNSYP LTFGQGTKVEIK | hu1C7_VL_4 |
| 608 | DIVMTQSPDSLAVSLGERATINCKSSQSLHNSGTQKDYLVWYQQKPGQPP KLLIYWASTRESGVPDRFSGSGSGTDFTLTISSLQAEDVAVYYCQQYNSYP LTFGQGTKVEIK | hu1C7_VL_5 |
| 609 | DIVMTQSPDSLAVSLGERATINCKSSQSLHMSGTQKDYLVWYQQKPGQP PKLLIYWASTRESGVPDRFSGSGSGTDFTLTISSLQAEDVAVYYCQQYNSY PLTFGQGTKVEIK | hu1C7_VL_6 |
| 610 | DIVMTQSPDSLAVSLGERATINCKSSQSLHQSGTQKDYLVWYQQKPGQPP KLLIYWASTRESGVPDRFSGSGSGTDFTLTISSLQAEDVAVYYCQQYNSYP LTFGQGTKVEIK | hu1C7_VL_7 |
| 611 | DIVMTQSPDSLAVSLGERATINCKSSQSLHKSGTQKDYLVWYQQKPGQPP KLLIYWASTRESGVPDRFSGSGSGTDFTLTISSLQAEDVAVYYCQQYNSYP LTFGQGTKVEIK | hu1C7_VL_8 |
| 612 | DIVMTQSPDSLAVSLGERATINCKSSQSLHLSGTQKDYLVWYQQKPGQPP KLLIYWASTRESGVPDRFSGSGSGTDFTLTISSLQAEDVAVYYCQQYNSYP LTFGQGTKVEIK | hu1C7_VL_9 |
| 613 | DIVMTQSPDSLAVSLGERATINCKSSQSLHRSGNQKDYLVWYQQKPGQPP KLLIYWASTRESGVPDRFSGSGSGTDFTLTISSLQAEDVAVYYCQQYNSYP LTFGQGTKVEIK | hu1C7_VL_10 |
| 614 | DIVMTQSPDSLAVSLGERATINCKSSQSLHRSGTQKNYLVWYQQKPGQPP KLLIYWASTRESGVPDRFSGSGSGTDFTLTISSLQAEDVAVYYCQQYNSYP LTFGQGTKVEIK | hu1C7_VL_11 |
| 615 | DIVMTQSPDSLAVSLGERATINCKSSQSLHRSGTQKDYLAWYQQKPGQPP KLLIYWASTRESGVPDRFSGSGSGTDFTLTISSLQAEDVAVYYCQQYNSYP LTFGQGTKVEIK | hu1C7_VL_12 |
| 616 | DIVMTQSPDSLAVSLGERATINCKSSQSLHRSGTQKDYLVWYQQKPGQPP KLLIYWASTRESGVPDRFSGSGSGTDFTLTISSLQAEDVAVYYCQQYSSYP LTFGQGTKVEIK | hu1C7_VL_13 |

| SEQ ID NO | Sequence | Description |
|---|---|---|
| 617 | $X_1X_2X_3X_4X_5X_6X_7GX_8S$, wherein $X_1$ is G or V; $X_2$ is F or I; $X_3$ is T, K, R, Q, or M; $X_4$ is F or W; $X_5$ is S or R; $X_6$ is S, R, G, I, Q, M, L, or K; $X_7$ is Y, V, or P; and $X_8$ is M, V, or T | hu1C7.v2-like CDR-H1 consensus_3 |
| 618 | $KSSX_1SLX_2X_3X_4X_5X_6X_7X_8X_9YLX_{10}$, wherein $X_1$ is Q or H; $X_2$ is L, Y, H, or V; $X_3$ is N, S, R, Y, Q, M, K, or L; $X_4$ is S or A; $X_5$ is G or R; $X_6$ is N, R, K, or T; $X_7$ is Q, H, or R; $X_8$ is K or Q; $X_9$ is N, H, or D; and $X_{10}$ is T, A, or V | hu1C7.v2-like CDR-L1 consensus_3 |
| 619 | $QX_1YX_2X_3YPX_4T$, wherein $X_1$ is Q, K, or H; $X_2$ is N, D, R, Y, or S; $X_3$ is S, T, or A; and $X_4$ is L or M | hu1C7.v2-like CDR-L3 consensus_3 |
| 620 | $X_1X_2X_3X_4X_5X_6X_7X_8X_9X_{10}$, wherein $X_1$ is G, V, or R; $X_2$ is F or I; $X_3$ is T, K, R, Q, M, or N; $X_4$ is F, W, or I; $X_5$ is S, R, E, or K; $X_6$ is S, R, G, I, Q, M, L, K, or D; $X_7$ is Y, V, P, or D; $X_8$ is G or Y; $X_9$ is M, V, or T; and $X_{10}$ is S or H | hu1C7.v2-like CDR-H1 consensus_4 |
| 621 | $SISGX_1X_2GSYIX_3YAX_4X_5VK$, wherein $X_1$ is D, E, T, or S; $X_2$ is G or A; $X_3$ is H or R; $X_4$ is D or S; and $X_5$ is S or A | hu1C7.v2-like CDR-H2 consensus_2 |
| 622 | $X_1X_2LX_3X_4$, wherein $X_1$ is A, T, or N; $X_2$ is R, K, or T; $X_3$ is P or R; and $X_4$ is Y or F | hu1C7.v2-like CDR-H3 consensus_2 |
| 623 | $X_1X_2SX_3X_4X_5X_6$, wherein $X_1$ is S, W, R, or L; $X_2$ is A, M, or V; $X_3$ is Y, T, F, N, or K; $X_4$ is R, L, or K; $X_5$ is Y, H, A, or E; and $X_6$ is S or T | hu1C7.v2-like CDR-L2 consensus_1 |
| 624 | $X_1X_2X_3X_4X_5X_6PX_7T$, wherein $X_1$ is Q, A, V, or P; $X_2$ is Q, K, H, or L; $X_3$ is Y, M, G, or S; $X_4$ is N, D, R, Y, S, L, or T; $X_5$ is S, T, A, E, or H; $X_6$ is Y, R, F, or D; and $X_7$ is L, M, or Y | hu1C7.v2-like CDR-L3 consensus_4 |
| 625 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLTCLVKGFYPSDIAVE WESNGQPENNYKTTPPVLDSDGSFFLYSKLTVDKSRWQQGNVFSCSVLH EALHSHYTQKSLSLSPGK | Fc sequence with M198L and N204S mutations |
| 626 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESNGQPENNYKTTPPVLDSDGSFFLYSKLTVDKSRWQQGNVFSCSVL HEALHSHYTQKSLSLSPGK | Fc sequence with knob and M198L and N204S mutations |
| 627 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLWCLVKGFYPSDIAV EWESNGQPENNYKTTPPVLDSDGSFFLYSKLTVDKSRWQQGNVFSCSVL HEALHSHYTQKSLSLSPGK | Fc sequence with knob, LALA, and M198L and N204S mutations |
| 628 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLWCLVKGFYPSDIAV EWESNGQPENNYKTTPPVLDSDGSFFLYSKLTVDKSRWQQGNVFSCSVL HEALHSHYTQKSLSLSPGK | Fc sequence with knob, LALAPG, and M198L and N204S mutations |
| 629 | APELLGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESNGQPENNYKTTPPVLDSDGSFFLVSKLTVDKSRWQQGNVFSCSVLH EALHSHYTQKSLSLSPGK | Fc sequence with hole and M198L and N204S mutations |
| 630 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL PAPIEKTISKAKGQPREPQVYTLPPSRDELTKNQVSLSCAVKGFYPSDIAVE WESNGQPENNYKTTPPVLDSDGSFFLVSKLTVDKSRWQQGNVFSCSVLH EALHSHYTQKSLSLSPGK | Fc sequence with hole, LALA, and M198L and N204S mutations |

INFORMAL SEQUENCE LISTING

| SEQ ID NO | Sequence | Description |
|---|---|---|
| 631 | APEAAGGPSVFLFPPKPKDTLMISRTPEVTCVVVDVSHEDPEVKFNWYVD GVEVHNAKTKPREEQYNSTYRVVSVLTVLHQDWLNGKEYKCKVSNKAL GAPIEKTISKAKGQPREPQVYTLPPSRDELTKNQVSLSCAVKGFYPSDIAV EWESNGQPENNYKTTPPVLDSDGSFFLVSKLTVDKSRWQQGNVFSCSVL HEALHSHYTQKSLSLSPGK | Fc sequence with hole, LALAPG, and M198L and N204S mutations |
| 632 | AAGHV | Part of Tau epitope TPSLEDEAAGHVT QA |
| 633 | WASX$_1$RX$_2$S, wherein X$_1$ is T or Y and X$_2$ is E or Y | A light chain CDR2 |
| 634 | QQYX$_1$X$_2$YPLT, wherein X$_1$ is N or S and X$_2$ is S or T | a light chain CDR3 |
| 635 | YxTEWSS | Consensus sequence |
| 636 | TxxExxxxF | Consensus sequence |
| 637 | DIVMTQSPDSLAVSLGERATINCKSSQSVLYSSNNKNYLAWYQQKPGQPP KLLIYWASTRESGVPDRFSGSGSGTDFTLTISSLQAEDVAVYYCQQYYST PFTFGQGTKVEIKR | IGKV4 (FIG. 3) |
| 638 | DIVMTQSPDSLAVSLGERATINCKSSQSVLYSSNNKNYLAWYQQKPGQPP KLLIYWASTRESGVPDRFSGSGSGTDFTLTISSLQAEDVAVYYCQQYYSTP FGQGTKVEIKR | k4 consensus (FIG. 3) |
| 639 | gacatcgtgatgacccagagcccagacagcctggccgtgagcctgggcgagcgcgc caccatcaactgcaagagcagccagagcctgctgaacagcggcaaccagaagaact acctgacctggtaccagcagaagccaggccagccaccaaagctgctgatctact gggccagcacccgcgagagcggcgtgccagaccgcttcagcggcagcggcagcggc accgacttcaccctgaccatcagcagcctgcaggccgaggacgtggccgtgtacta ctgccagcagtagaacagctacccactgaccttcggccagggcaccaaggtgg agatcaagcgc | DNA (FIG. 3) |
| 640 | EVQLLESGGGLVQPGGSLRLSCAASGFTFSSYAMSWVRQAPGKGLEWVS AISGSGGSTYYADSVKGRFTISRDNSKNTLYLQMNSLRAEDTAVYYCAKF DYWGQGTLVTVSS | IGHV3, H4 consensus (FIG. 3 cont'd) |
| 641 | gaggtgcagctgctggagagcggcggcggcctggtgcagccaggcggcagcctgcg cctgagctgcgccgccagcggcttcaccttcagcagctacggcatgagctgggt gcgccaggcccaggcaagggcctggagtgggtggccagcatcagcggcgacggc ggcagctacatccactacgccgacagcgtgaagggccgcttcaccatcagccg cgacaacagcaagaacaccctgtacctgcagatgaacagcctgcgcgccgagg acaccgccgtgtactactgcgcccgcctgccatactggggccagggcaccctg gtgaccgtgagcagc | DNA (FIG. 3 cont'd) |
| 642 | DIVMTQTPLSLSVTPGQPASISCKSSQSLLHSDGKTYLYWYLQKPGQSPQL LIYEVSSRFSGVPDRFSGSGSGTDFTLKISRVEAEDVGVYYMQGIHLPFTF GQGTKVEIKR | IGKV2 (FIG. 4, FIG. 5, FIG. 6, FIG. 7) |
| 643 | DIVMTQTPLSLPVTPGQPASISCRSSQSLLHSSGNTYLDWYLQKPGQSPQL LIYLGSNRASGVPDRFSGSGSGTDFTLKISRVEAEDVGVYYCQQAIQFPFG QGTKVEIKR | k2 consensus (FIG. 4, FIG. 5, FIG. 6, FIG. 7) |
| 644 | DIVMTQTPLSLPVTPGQPASISCKSSQSLLYSDGKTYLNWYLQKPGQSPQL LIYLVSKLESGVPDRFSGSGSGTDFTLKISRVEAEDVGVYYCVQGTHFPFT FGQGTKVEIKR | CDR graft (FIG. 4) |
| 645 | gacatcgtgatgacccagaccccactgagcctgccagtgaccccaggccagccagc cagcatcagctgcaagagcagccagagcctgctgtacagcgacggcaagacctacc tgaactggtacctgcagaagccaggccagagcccacagctgctgatctac ctggtgagcaagctggagagcggcgtgccagaccgcttcagcggcagcgg cagcggcaccgacttcaccctgaagatcagccgcgtggaggccgaggacg tgggcgtgtactactgcgtgcagggcacccacttcccattcaccttcggc cagggcaccaaggtggagatcaagcgc | DNA (FIG. 4) |
| 646 | EVQLVQSGAEVKKPGATVKISCKVSGYIFTDYYMHWVQQAPGKGLEW MGLVDPEDGETIYAEKFQGRVTITADTSTDTAYMELSSLRSEDTAVYYCA TFDYWGQGTLVTVSS | IGHVI, H1 consensus (FIG. 4 cont'd, FIG. 5 cont'd, FIG. 6 cont'd, FIG. 7 cont'd) |

-continued

INFORMAL SEQUENCE LISTING

| SEQ ID NO | Sequence | Description |
|---|---|---|
| 647 | EVQLVQSGAEVKKPGATVKISCKVSGFNIKDSLMHWVQQAPGKGLEWM GWIDPEDGETKYAPKFQDRVTITADTSTDTAYMELSSLRSEDTAVYYCTR RDWEGPWGQGTLVTVSS | CDR graph (FIG. 4 cont'd) |
| 648 | gacgtgcagctggtgcagagcggcgccgaggtgaagaagccaggcgccgccgtgaa gatcagctgcaaggtgagcggcttcaacatcaaggacagcctgatgcactgggtgc agcaggcccaggcaagggcctggagtggatgggctggatcgacccaga ggacggcgagaccaagtacgccccaaagttccaggaccgcgtgaccatc accgccgacaccagcaccgacaccgcctacatggagctgagcagcctgc gcagcgaggacaccgccgtgtactactgcacccgccgcgactgggaggg cccatggggccagggcaccctggtgaccgtgagcagc | DNA (FIG. 4 cont'd) |
| 649 | DIVMTQTPLSLPVTPGQPASISCKSSQSLLYSDGKTYLNWYLQKPGQSPQL LIYLVSKLESGVPDRFSGSGSGTDFTLKISRVEAEDVGVYYCVQGTHFPYT FGQGTKVEIKR | CDR graft (FIG. 5, FIG. 6, FIG. 7) |
| 650 | gacatcgtgatgacccagaccccactgagcctgccagtgaccccaggccagccagc cagcatcagctgcaagagcagccagagcctgctgtacagcgacggcaagacctacc tgaactggtacctgcagaagccaggccagagcccacagctgctgatcta cctggtgagcaagctggagagcggcgtgccagaccgcttcagcggcagc ggcagcggcaccgacttcaccctgaagatcagccgcgtggaggccgagg acgtgggcgtgtactactgcgtgcagggcacccacttcccatacaccttt cggccagggcaccaaggtggagatcaagcgc | DNA (FIG. 5) |
| 651 | EVQLVQSGAEVKKPGATVKISCKVSGFNIKDSLIHWVQQAPGKGLEWMG WIDPEDGETKYAPKFQDRVTITADTSTDTAYMELSSLRSEDTAVYYCASG EWDYWGQGTLVTVSS | CDR graft (FIG. 5 cont'd) |
| 652 | gaggtccagctggtgcagagcggcgccgaggtgaagaagccaggcgccaccgtgaa gatcagctgcaaggtgagcggcttcaacatcaaggacagcctgatccactgggtgc agcaggcccaggcaagggcctggagtggatgggctggactgaccc agaggacggcgagaccaagtacgccccaaagttccaggaccgcgtg accatcaccgccgacaccagcaccgacaccgcctacatggagctgagc gcagcctgcgcagcgaggacaccgccgtgtactactgcgccagcgg cgagtgggactactggggccagggcaccctggtgaccgtgagcagc | DNA (FIG. 5, cont'd) |
| 653 | gacatcctgatgacccagaccccactgagcctgccagtgaccccaggccagccagc cagcatcagctgcaagagcagccagagcctgctgtacagcgacggcaagacctacc tgaactggtacctgcagaagccaggccagagcccacagctgctgat ctacctggtgagcaagctggagagcggcgtgccagaccgcttcagc ggcagcggcagcggcaccgacttcaccctgaagatcagccgcgtgg aggccgaggacgtgggcgtgtactactgcgtgcagggcacccactt cccatacaccttcggccagggcaccaaggtggagatcaagcgc | DNA (FIG. 6) |
| 654 | EVQLVQSGAEVKKPGATVKISCKVSGFNIKDSLMHWVQQAPGKGLEWM GWIDPEDGETKYAPKFQDRVTITADTSTDTAYIVIELSSLRSEDTAVYYCVR GDWDGGYWGQGTLVTVSS | CDR graft (FIG. 6 cont'd) |
| 655 | gaggtgcagctggtgcagagcggcgccgaggtgaagaagccaggcgcca ccgtgaagatcagctgcaaggtgagcggcttcaacatcaaggacagcct gatgcactgggtgcagcaggcccaggcaagggcctggagtggatgggc tggatcgacccagaggacggcgagaccaagtacgccccaaagttccagg accgcgtgaccatcaccgccgacaccagcaccgacaccgcctacatgga gctgagcagcctgcgcagcgaggacaccgccgtgtactactgcgtgcgc ggcgactgggacggcggctactggggccagggcaccctggtgaccgtgagcagc | DNA (FIG. 6 cont'd) |
| 656 | gacatcgtgatgacccagaccccactgagcctgccagtgaccccaggccagccagc cagcatcagctgcaagagcagccagagcctgctgtacagcgacggcaagacctacc tgaactggtacctgcagaagccaggccagagcccacagctgctgatctac ctggtgagcaagctggagagcggcgtgccagaccgcttcagcggcagcgg cagcggcaccgacttcaccctgaagatcagccgcgtgcaggccgaggacg tgggcgtgtactactgcgtgcagggcacccacttcccatacaccttcggc cagggcaccaaggtggagatcaagcgc | DNA (FIG. 7) |
| 657 | EVQLVQSGAEVKKPGATVKISCKVSGFNIKDSLMHWVQQAPGKGLEWM GWIDPEDGETKYAPKFQDRVTITADTSTDTAYMELSSLRSEDTAVYYCAR RDWEGPWGQGTLVTVSS | CDR graft (FIG. 7, cont'd) |
| 658 | gaggtgcagctggtgcagagcggcgccgaggtgaagaagccaggcgccaccgtgaa gatcagctgcaaggtgagcggcttcaacatcaaggacagcctgatgcactgggtgc agcaggcccaggcaagggcctggagtggatgggctggatcgacccagag gacggcgagaccaagtacgccccaaagttccaggaccgcgtgaccatcac | DNA (FIG. 7, cont'd) |

-continued

INFORMAL SEQUENCE LISTING

| SEQ ID NO | Sequence | Description |
|---|---|---|
| | cgccgacaccagcaccgacaccgcctacatggagctgagcagcctgcgca gcgaggacaccgccgtgtactactgcgcccgccgcgactgggagggccca tggggccagggcaccctggtgaccgtgagcagc | |

SEQUENCE LISTING (658 sequences)

SEQ ID NO: 1 - protein, 441 aa, Homo sapiens
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 2 - protein, 97 aa, Artificial Sequence
  Synthetic construct
MGHHHHHHSGEVKPEVKPETHINLKVSDGSSEIFFKIKKTTPLRRLMEAFAKRQGKEMDSLRFLYDGIRIQADQTPEDLDMEDNDIIEAHREQIGGS

SEQ ID NO: 3 - protein, 538 aa, Artificial Sequence
  Synthetic construct
MGHHHHHHSGEVKPEVKPETHINLKVSDGSSEIFFKIKKTTPLRRLMEAFAKRQGKEMDSLRFLYDGIRIQADQTPEDLDMEDNDIIEAHREQIGGSMAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 4 - protein, 421 aa, Artificial Sequence
  Synthetic construct
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVD

SEQ ID NO: 5 - protein, 392 aa, Artificial Sequence
  Synthetic construct
TPTEDGSEEPGSETSDAKSTPTAEDVTAPLVDEGAPGKQAAAQPHTEIPEGTTAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 6 - protein, 430 aa, Mus musculus
MADPRQEFDTMEDHAGDYTLLQDQEGDMDHGLKESPPQPPADDGAEEPGSETSDAKSTPTAEDVTAPLVDERAPDKQAAAQPHTEIPEGITAEEAGIGDTPNQEDQAAGHVTQARVASKDRTGNDEKKAKGADGKTGAKIATPRGAASPAQKGTSNATRIPAKTTPSPKTPPGSGEPPKSGERSGYSSPGSPGTPGSRSRTPSLPTPPTREPKKVAVVRTPPKSPSASKSRLQTAPVPMPDLKNVRSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 7 - protein, 441 aa, Macaca fascicularis
MAEPRQEFDVMEDHAGTYGLGDRKDQEGYTMLQDQEGDTDAGLKESPLQTPAEDGSEELGSETSDAKSTPTAEDVTAPLVDERAPGEQAAAQPHMEIPEGTTAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPAREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 8 - protein, 115 aa, Artificial Sequence
  Synthetic construct
EVQLQQSGAELVRPGASVRLSCTASGFNIKDSLMHWLKQRPEQGLEWIGWIDPEDGETKYAPKFQDKATITADTSSNTAYLQLSSLTSEDTAIYYCTRRDWEGPWGQGTLVTVSA

SEQ ID NO: 9 - protein, 10 aa, Artificial Sequence
  Synthetic construct
GFNIKDSLMH

SEQ ID NO: 10 - protein, 17 aa, Artificial Sequence
  Synthetic construct
WIDPEDGETKYAPKFQD

SEQ ID NO: 11 - protein, 8 aa, Artificial Sequence
  Synthetic construct
TRRDWEGP

SEQ ID NO: 12 - protein, 113 aa, Artificial Sequence
  Synthetic construct
DIVMTQTPLTLSVTIGQPASISCKSSQSLLYSDGKTYLNWLLQSPGQSPKLLIYLVSKLESGVPDRFSGSGSGTDFTLKISRVEAEDLGVYYCVQGTHFPFTFGSGTKLEIKR

SEQ ID NO: 13 - protein, 16 aa, Artificial Sequence
  Synthetic construct
KSSQSLLYSDGKTYLN

SEQ ID NO: 14 - protein, 7 aa, Artificial Sequence
  Synthetic construct
LVSKLES

SEQ ID NO: 15 - protein, 9 aa, Artificial Sequence
  Synthetic construct
VQGTHFPFT

SEQ ID NO: 16 - protein, 114 aa, Artificial Sequence
  Synthetic construct
EVQLQQSGAELVRPGASVKLSCTASGFNIKDSLIHWVKQRPEQGLEWIGWIDPEDGETKYAPKFQDKATKTADTSSNTAYLQLSSLTSEDTAIYYCASGEWDYWGQGTSVTVSS

SEQ ID NO: 17 - protein, 10 aa, Artificial Sequence
  Synthetic construct
GFNIKDSLIH

SEQ ID NO: 18 - protein, 7 aa, Artificial Sequence
  Synthetic construct
ASGEWDY

SEQ ID NO: 19 - protein, 113 aa, Artificial Sequence
  Synthetic construct
DVVMTQTPLTLSVTIGQPASISCKSSQSLLYSDGKTYLNWLLQSPGQSPKLLIYLVSKLESGVPDRFSGSGSGTDFTLKISRVEAEDLGVYYCVQGTHFPYTFGGGTKLELKR

SEQ ID NO: 20 - protein, 9 aa, Artificial Sequence
  Synthetic construct
VQGTHFPYT

SEQ ID NO: 21 - protein, 113 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSA

SEQ ID NO: 22 - protein, 10 aa, Artificial Sequence
  Synthetic construct
GFTFSSYGMS

SEQ ID NO: 23 - protein, 17 aa, Artificial Sequence
  Synthetic construct
SISGDGGSYIHYADSVK

SEQ ID NO: 24 - protein, 5 aa, Artificial Sequence
  Synthetic construct
ARLPY

SEQ ID NO: 25 - protein, 114 aa, Artificial Sequence
  Synthetic construct
DIVMTQSPSSLTVTAGEKVTMSCKSSQSLLNSGNQKNYLTWYQQKPGQPPKLLIYWASTRESGVPDRFTGSGSGTDFTLTISNVQSEDLAEYFCQQYNSYPLTFGAGTKLELKR

SEQ ID NO: 26 - protein, 17 aa, Artificial Sequence
  Synthetic construct
KSSQSLLNSGNQKNYLT

SEQ ID NO: 27 - protein, 7 aa, Artificial Sequence
  Synthetic construct
WASTRES

SEQ ID NO: 28 - protein, 9 aa, Artificial Sequence
  Synthetic construct
QQYNSYPLT

SEQ ID NO: 29 - protein, 116 aa, Artificial Sequence
  Synthetic construct
EVQLQQSGAELVRPGASVKLSCTASGFNIKDSLMHWMKQRPEQGLEWIGWIDPEDGETKYAPKFQDKATLTADTSSNAAYLQLSSLTSEDTAIYYCVRGDWDGGYWGQGTTLTVSS

SEQ ID NO: 30 - protein, 9 aa, Artificial Sequence
  Synthetic construct
VRGDWDGGY

SEQ ID NO: 31 - protein, 113 aa, Artificial Sequence
  Synthetic construct
DVVMTQTPLSLSVTIGQPASISCKSSQSLLYSDGKTYLNWLQQRPGQSPKLLIYLVSKLESGVPDRFSGSGSGTDFTLKISRVEAEDLGVYYCVQGTHFPYTFGGGTKLELKR

SEQ ID NO: 32 - protein, 115 aa, Artificial Sequence
  Synthetic construct
EVQLQQSGAEVVRPGASVKLSCTTSGFNIKDSLMHWLKQRPEQGLEWIGWIDPEDGETKYAPKFQDKATITADTSSNTAYLQLSSLTSGDTAIYYCARRDWEGPWGQGTLVTVSA

SEQ ID NO: 33 - protein, 8 aa, Artificial Sequence
  Synthetic construct
ARRDWEGP

SEQ ID NO: 34 - protein, 113 aa, Artificial Sequence
  Synthetic construct
DIVMTQTPLTLSVTIGQPASISCKSSQSLLYSDGKTYLNWLLQSPGQSPKLLIYLVSKLESGVPDRFSGSGSGTDFTLKISRVEAEDLGVYYCVQGTHFPYTFGGGTKLELKR

SEQ ID NO: 35 - protein, 15 aa, Artificial Sequence
  Synthetic construct
TPSLEDEAAGHVTQA

SEQ ID NO: 36 - protein, 20 aa, Artificial Sequence
  Synthetic construct
PDLKNVKSKIGSTENLKHQP

SEQ ID NO: 37 - protein, 15 aa, Artificial Sequence
  Synthetic construct
VKSKIGSTENLKHQP

SEQ ID NO: 38 - protein, 15 aa, Artificial Sequence
  Synthetic construct
FKDRVQSKIGSLDNI

SEQ ID NO: 39 - protein, 5 aa, Artificial Sequence
  Synthetic construct
SKIGS

SEQ ID NO: 40 - protein, 113 aa, Artificial Sequence; identical to SEQ ID NO: 21
  Synthetic construct

SEQ ID NO: 41 - protein, 108 aa, Artificial Sequence
  Synthetic construct
DIVMTQSQKFMSTSVGDRVSVTCKASQNVGTNVAWYQQKPGQSPKALIYSASYRYSGVPDRFTGSGSGTDFTLTISNVQSEDLAEYFCQQYNTYPLTFGAGTKLELKR

SEQ ID NO: 42 - protein, 11 aa, Artificial Sequence
  Synthetic construct
KASQNVGTNVA

SEQ ID NO: 43 - protein, 7 aa, Artificial Sequence
  Synthetic construct
SASYRYS

SEQ ID NO: 44 - protein, 9 aa, Artificial Sequence
  Synthetic construct
QQYNTYPLT

SEQ ID NO: 45 - protein, 108 aa, Artificial Sequence
  Synthetic construct
DIVMTQSQKFISTSVGDRVSITCKASQNVGTNVAWYQQKPGQSPKALIYSASYRYSGVPDRFTGSGSGTDFTLTISNVQSEDLADYFCQQYSSYPLTFGAGTKLEIKR

SEQ ID NO: 46 - protein, 9 aa, Artificial Sequence
  Synthetic construct
QQYSSYPLT

SEQ ID NO: 47 - protein, 10 aa, Artificial Sequence
  Synthetic construct
  misc_feature (9)..(9): Xaa can be any naturally occurring amino acid
GFNIKDSLXH

SEQ ID NO: 48 - protein, 8 aa, Artificial Sequence
  Synthetic construct
  misc_feature (1)..(1): Xaa can be any naturally occurring amino acid
XRRDWEGP

SEQ ID NO: 49 - protein, 9 aa, Artificial Sequence
  Synthetic construct
  misc_feature (8)..(8): Xaa can be any naturally occurring amino acid
VQGTHFPXT

SEQ ID NO: 50 - protein, 7 aa, Artificial Sequence
  Synthetic construct
  misc_feature (4)..(4): Xaa can be any naturally occurring amino acid
  misc_feature (6)..(6): Xaa can be any naturally occurring amino acid
WASXRXS

SEQ ID NO: 51 - protein, 9 aa, Artificial Sequence
  Synthetic construct
  misc_feature (4)..(5): Xaa can be any naturally occurring amino acid
QQYXXYPLT

SEQ ID NO: 52 - protein, 352 aa, Homo sapiens
MAEPRQEFEVMEDHAGTYGLGDRKDQGGYTMHQDQEGDTDAGLKAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 53 - protein, 381 aa, Homo sapiens
MAEPRQEFEVMEDHAGTYGLGDRKDQGGYTMHQDQEGDTDAGLKESPLQTPTEDGSEEPGSETSDAKSTPTAEAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 54 - protein, 410 aa, Homo sapiens
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 55 - protein, 383 aa, Homo sapiens
MAEPRQEFEVMEDHAGTYGLGDRKDQGGYTMHQDQEGDTDAGLKAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 56 - protein, 412 aa, Homo sapiens
MAEPRQEFEVMEDHAGTYGLGDRKDQGGYTMHQDQEGDTDAGLKESPLQTPTEDGSEEPGSETSDAKSTPTAEAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 57 - protein, 15 aa, Artificial Sequence
  Synthetic construct
SEEPGSETSDAKSTP

SEQ ID NO: 58 - protein, 15 aa, Artificial Sequence
  Synthetic construct
PTEDGSEEPGSETSD

SEQ ID NO: 59 - protein, 15 aa, Artificial Sequence
  Synthetic construct
SPLQTPTEDGSEEPG

SEQ ID NO: 60 - protein, 15 aa, Artificial Sequence
  Synthetic construct
AGLKESPLQTPTEDG

SEQ ID NO: 61 - protein, 15 aa, Artificial Sequence
  Synthetic construct
EGDTDAGLKESPLQT

SEQ ID NO: 62 - protein, 15 aa, Artificial Sequence
  Synthetic construct
MHQDQEGDTDAGLKE

SEQ ID NO: 63 - protein, 15 aa, Artificial Sequence
  Synthetic construct
QGGYTMHQDQEGDTD

SEQ ID NO: 64 - protein, 15 aa, Artificial Sequence
  Synthetic construct
GDRKDQGGYTMHQDQ

SEQ ID NO: 65 - protein, 15 aa, Artificial Sequence
  Synthetic construct
GTYGLGDRKDQGGYT

SEQ ID NO: 66 - protein, 15 aa, Artificial Sequence
  Synthetic construct
MEDHAGTYGLGDRKD

SEQ ID NO: 67 - protein, 15 aa, Artificial Sequence
  Synthetic construct
QEFEVMEDHAGTYGL

SEQ ID NO: 68 - protein, 15 aa, Artificial Sequence
  Synthetic construct
MAEPRQEFEVMEDHA

SEQ ID NO: 69 - protein, 15 aa, Artificial Sequence
  Synthetic construct
DEAAGHVTQARMVSK

SEQ ID NO: 70 - protein, 15 aa, Artificial Sequence
  Synthetic construct
TPSLEDEAAGHVTQA

SEQ ID NO: 71 - protein, 15 aa, Artificial Sequence
  Synthetic construct
AGIGDTPSLEDEAAG

SEQ ID NO: 72 - protein, 15 aa, Artificial Sequence
  Synthetic construct
TTAEEAGIGDTPSLE

SEQ ID NO: 73 - protein, 15 aa, Artificial Sequence
  Synthetic construct
EIPEGTTAEEAGIGD

SEQ ID NO: 74 - protein, 15 aa, Artificial Sequence
  Synthetic construct
AQPHTEIPEGTTAEE

SEQ ID NO: 75 - protein, 15 aa, Artificial Sequence
  Synthetic construct
GKQAAAQPHTEIPEG

SEQ ID NO: 76 - protein, 15 aa, Artificial Sequence
  Synthetic construct
DEGAPGKQAAAQPHT

SEQ ID NO: 77 - protein, 15 aa, Artificial Sequence
  Synthetic construct
TAPLVDEGAPGKQAA

SEQ ID NO: 78 - protein, 15 aa, Artificial Sequence
  Synthetic construct
TAEDVTAPLVDEGAP

SEQ ID NO: 79 - protein, 15 aa, Artificial Sequence
  Synthetic construct
AKSTPTAEDVTAPLV

SEQ ID NO: 80 - protein, 15 aa, Artificial Sequence
  Synthetic construct
SETSDAKSTPTAEDV

SEQ ID NO: 81 - protein, 15 aa, Artificial Sequence
  Synthetic construct
PPAPKTPPSSGEPPK

SEQ ID NO: 82 - protein, 15 aa, Artificial Sequence
  Synthetic construct
IPAKTPPAPKTPPSS

SEQ ID NO: 83 - protein, 15 aa, Artificial Sequence
  Synthetic construct
ANATRIPAKTPPAPK

SEQ ID NO: 84 - protein, 15 aa, Artificial Sequence
  Synthetic construct
GQKGQANATRIPAKT

SEQ ID NO: 85 - protein, 15 aa, Artificial Sequence
  Synthetic construct
GAAPPGQKGQANATR

SEQ ID NO: 86 - protein, 15 aa, Artificial Sequence
  Synthetic construct
IATPRGAAPPGQKGQ

SEQ ID NO: 87 - protein, 15 aa, Artificial Sequence
  Synthetic construct
DGKTKIATPRGAAPP

SEQ ID NO: 88 - protein, 15 aa, Artificial Sequence
  Synthetic construct
KAKGADGKTKIATPR

SEQ ID NO: 89 - protein, 15 aa, Artificial Sequence
  Synthetic construct
GSDDKKAKGADGKTK

SEQ ID NO: 90 - protein, 15 aa, Artificial Sequence
  Synthetic construct
SKDGTGSDDKKAKGA

SEQ ID NO: 91 - protein, 15 aa, Artificial Sequence
  Synthetic construct
RMVSKSKDGTGSDDK

SEQ ID NO: 92 - protein, 15 aa, Artificial Sequence
  Synthetic construct
HVTQARMVSKSKDGT

SEQ ID NO: 93 - protein, 15 aa, Artificial Sequence
  Synthetic construct
GGSGGGSDYKDDDDK

SEQ ID NO: 94 - protein, 15 aa, Artificial Sequence
  Synthetic construct
TPPKSPSSAKSRLQT

SEQ ID NO: 95 - protein, 15 aa, Artificial Sequence
  Synthetic construct
VAVVRTPPKSPSSAK

SEQ ID NO: 96 - protein, 15 aa, Artificial Sequence
  Synthetic construct
REPKKVAVVRTPPKS

SEQ ID NO: 97 - protein, 15 aa, Artificial Sequence
  Synthetic construct
PTPPTREPKKVAVVR

SEQ ID NO: 98 - protein, 15 aa, Artificial Sequence
  Synthetic construct
RTPSLPTPPTREPKK

SEQ ID NO: 99 - protein, 15 aa, Artificial Sequence
  Synthetic construct
PGSRSRTPSLPTPPT

SEQ ID NO: 100 - protein, 15 aa, Artificial Sequence
  Synthetic construct
GSPGTPGSRSRTPSL

SEQ ID NO: 101 - protein, 15 aa, Artificial Sequence
  Synthetic construct
GYSSPGSPGTPGSRS

SEQ ID NO: 102 - protein, 15 aa, Artificial Sequence
  Synthetic construct
SGDRSGYSSPGSPGT

SEQ ID NO: 103 - protein, 15 aa, Artificial Sequence
  Synthetic construct
GEPPKSGDRSGYSSP

SEQ ID NO: 104 - protein, 15 aa, Artificial Sequence
  Synthetic construct
TPPSSGEPPKSGDRS

SEQ ID NO: 105 - protein, 15 aa, Artificial Sequence
  Synthetic construct
CGSKDNIKHVPGGGS

SEQ ID NO: 106 - protein, 15 aa, Artificial Sequence
  Synthetic construct
NVQSKCGSKDNIKHV

SEQ ID NO: 107 - protein, 15 aa, Artificial Sequence
  Synthetic construct
KLDLSNVQSKCGSKD

SEQ ID NO: 108 - protein, 15 aa, Artificial Sequence
  Synthetic construct
QIINKKLDLSNVQSK

SEQ ID NO: 109 - protein, 15 aa, Artificial Sequence
  Synthetic construct
GGGKVQIINKKLDLS

SEQ ID NO: 110 - protein, 15 aa, Artificial Sequence
  Synthetic construct
LKHQPGGGKVQIINK

SEQ ID NO: 111 - protein, 15 aa, Artificial Sequence
  Synthetic construct
GSTENLKHQPGGGKV

SEQ ID NO: 112 - protein, 15 aa, Artificial Sequence
  Synthetic construct
VKSKIGSTENLKHQP

SEQ ID NO: 113 - protein, 15 aa, Artificial Sequence
  Synthetic construct
PDLKNVKSKIGSTEN

SEQ ID NO: 114 - protein, 15 aa, Artificial Sequence
  Synthetic construct
APVPMPDLKNVKSKI

SEQ ID NO: 115 - protein, 15 aa, Artificial Sequence
  Synthetic construct
SRLQTAPVPMPDLKN

SEQ ID NO: 116 - protein, 15 aa, Artificial Sequence
  Synthetic construct
PSSAKSRLQTAPVPM

SEQ ID NO: 117 - protein, 15 aa, Artificial Sequence
  Synthetic construct
FKDRVQSKIGSLDNI

SEQ ID NO: 118 - protein, 15 aa, Artificial Sequence
  Synthetic construct
SEKLDFKDRVQSKIG

SEQ ID NO: 119 - protein, 15 aa, Artificial Sequence
  Synthetic construct
QVEVKSEKLDFKDRV

SEQ ID NO: 120 - protein, 15 aa, Artificial Sequence
  Synthetic construct
KPGGGQVEVKSEKLD

SEQ ID NO: 121 - protein, 15 aa, Artificial Sequence
  Synthetic construct
GNIHHKPGGGQVEVK

SEQ ID NO: 122 - protein, 15 aa, Artificial Sequence
  Synthetic construct
KCGSLGNIHHKPGGG

SEQ ID NO: 123 - protein, 15 aa, Artificial Sequence
  Synthetic construct
SKVTSKCGSLGNIHH

SEQ ID NO: 124 - protein, 15 aa, Artificial Sequence
  Synthetic construct
KPVDLSKVTSKCGSL

SEQ ID NO: 125 - protein, 15 aa, Artificial Sequence
  Synthetic construct
VQIVYKPVDLSKVTS

SEQ ID NO: 126 - protein, 15 aa, Artificial Sequence
  Synthetic construct
PGGGSVQIVYKPVDL

SEQ ID NO: 127 - protein, 15 aa, Artificial Sequence
  Synthetic construct
NIKHVPGGGSVQIVY

SEQ ID NO: 128 - protein, 15 aa, Artificial Sequence
  Synthetic construct
RHLSNVSSTGSIDMV

SEQ ID NO: 129 - protein, 15 aa, Artificial Sequence
  Synthetic construct
GDTSPRHLSNVSSTG

SEQ ID NO: 130 - protein, 15 aa, Artificial Sequence
  Synthetic construct
SPVVSGDTSPRHLSN

SEQ ID NO: 131 - protein, 15 aa, Artificial Sequence
  Synthetic construct
EIVYKSPVVSGDTSP

SEQ ID NO: 132 - protein, 15 aa, Artificial Sequence
  Synthetic construct
TDHGAEIVYKSPVVS

SEQ ID NO: 133 - protein, 15 aa, Artificial Sequence
  Synthetic construct
NAKAKTDHGAEIVYK

SEQ ID NO: 134 - protein, 15 aa, Artificial Sequence
  Synthetic construct
LTFRENAKAKTDHGA

SEQ ID NO: 135 - protein, 15 aa, Artificial Sequence
  Synthetic construct
IETHKLTFRENAKAK

SEQ ID NO: 136 - protein, 15 aa, Artificial Sequence
  Synthetic construct
GGNKKIETHKLTFRE

SEQ ID NO: 137 - protein, 15 aa, Artificial Sequence
  Synthetic construct
THVPGGGNKKIETHK

SEQ ID NO: 138 - protein, 15 aa, Artificial Sequence
  Synthetic construct
SLDNITHVPGGGNKK

SEQ ID NO: 139 - protein, 15 aa, Artificial Sequence
  Synthetic construct
QSKIGSLDNITHVPG

SEQ ID NO: 140 - protein, 15 aa, Artificial Sequence
  Synthetic construct
TLADEVSASLAKQGL

SEQ ID NO: 141 - protein, 15 aa, Artificial Sequence
  Synthetic construct
ATLADEVSASLAKQG

SEQ ID NO: 142 - protein, 15 aa, Artificial Sequence
  Synthetic construct
DSPQLATLADEVSAS

SEQ ID NO: 143 - protein, 15 aa, Artificial Sequence
  Synthetic construct
SIDMVDSPQLATLAD

SEQ ID NO: 144 - protein, 15 aa, Artificial Sequence
  Synthetic construct
VSSTGSIDMVDSPQL

SEQ ID NO: 145 - protein, 113 aa, Artificial Sequence
  Synthetic construct
EVQLLESGGGLVQPGGSLRLSCAASGFTFSSYGMSWVRQAPGKGLEWVSSISGDGGSYIHYADSVKGRFTISRDNSKNTLYLQMNSLRAEDTAVYYCARLPYWGQGTLVTVSS

SEQ ID NO: 146 - protein, 113 aa, Artificial Sequence
  Synthetic construct
EVQLLESGGGLVQPGGSLRLSCAASGFTFSSYGMSWVRQAPGKGLEWVASISGDGGSYIHYADSVKGRFTISRDNSKNTLYLQMNSLRAEDTAVYYCARLPYWGQGTLVTVSS

SEQ ID NO: 147 - protein, 113 aa, Artificial Sequence
  Synthetic construct
EVQLLESGGGLVQPGGSLRLSCAASGFTFSSYGMSWVRQAPGKGLEWVSSISGDGGSYIHYADSVKGRFTISRDNAKNTLYLQMNSLRAEDTAVYYCARLPYWGQGTLVTVSS

SEQ ID NO: 148 - protein, 113 aa, Artificial Sequence
  Synthetic construct
EVQLLESGGGLVQPGGSLRLSCAASGFTFSSYGMSWVRQAPGKGLEWVASISGDGGSYIHYADSVKGRFTISRDNAKNTLYLQMNSLRAEDTAVYYCARLPYWGQGTLVTVSS

SEQ ID NO: 149 - protein, 114 aa, Artificial Sequence
  Synthetic construct
DIVMTQSPDSLAVSLGERATINCKSSQSLLNSGNQKNYLTWYQQKPGQPPKLLIYWASTRESGVPDRFSGSGSGTDFTLTISSLQAEDVAVYYCQQYNSYPLTFGQGTKVEIKR

SEQ ID NO: 150 - protein, 10 aa, Artificial Sequence
  Synthetic construct
GFKFSRVGVS

SEQ ID NO: 151 - protein, 10 aa, Artificial Sequence
  Synthetic construct
GFTFSRVGTS

SEQ ID NO: 152 - protein, 10 aa, Artificial Sequence
  Synthetic construct
GFRFSRVGMS

SEQ ID NO: 153 - protein, 10 aa, Artificial Sequence
  Synthetic construct
GFRFSGPGMS

SEQ ID NO: 154 - protein, 10 aa, Artificial Sequence
  Synthetic construct
VIKWRIYGMS

SEQ ID NO: 155 - protein, 5 aa, Artificial Sequence
  Synthetic construct
AKLPF

SEQ ID NO: 156 - protein, 17 aa, Artificial Sequence
  Synthetic construct
KSSHSLYSSRRHKHYLA

SEQ ID NO: 157 - protein, 17 aa, Artificial Sequence
  Synthetic construct
KSSQSLLRSGKRQNYLV

SEQ ID NO: 158 - protein, 17 aa, Artificial Sequence
  Synthetic construct
KSSQSLHRSGTQKDYLV

SEQ ID NO: 159 - protein, 9 aa, Artificial Sequence
  Synthetic construct
QKYNSYPLT

SEQ ID NO: 160 - protein, 9 aa, Artificial Sequence
  Synthetic construct
QKYDSYPLT

SEQ ID NO: 161 - protein, 9 aa, Artificial Sequence
  Synthetic construct
QHYRTYPLT

SEQ ID NO: 162 - protein, 9 aa, Artificial Sequence
  Synthetic construct
QHYRSYPMT

SEQ ID NO: 163 - protein, 10 aa, Artificial Sequence
  Synthetic construct
  MISC_FEATURE (1)..(1): Xaa = Gly or Val
  MISC_FEATURE (2)..(2): Xaa = Phe or Ile
  MISC_FEATURE (3)..(3): Xaa = Thr, Lys, or Arg
  MISC_FEATURE (4)..(4): Xaa = Thr, Lys, or Arg
  MISC_FEATURE (5)..(5): Xaa = Ser or Arg
  MISC_FEATURE (6)..(6): Xaa = Ser, Arg, Gly, or Ile
  MISC_FEATURE (7)..(7): Xaa = Tyr, Val, or Pro
  MISC_FEATURE (9)..(9): Xaa = Met, Val, or Thr
XXXXXXXGXS

SEQ ID NO: 164 - protein, 5 aa, Artificial Sequence
  Synthetic construct
  MISC_FEATURE (2)..(2): Xaa = Arg or Lys
  MISC_FEATURE (5)..(5): Xaa = Tyr or Phe
AXLPX

SEQ ID NO: 165 - protein, 17 aa, Artificial Sequence
  Synthetic construct
  MISC_FEATURE (4)..(4): Xaa = Gln or His
  MISC_FEATURE (7)..(7): Xaa = Leu, Tyr, or His
  MISC_FEATURE (8)..(8): Xaa = Asn, Ser, or Arg
  MISC_FEATURE (10)..(10): Xaa = Gly or Arg
  MISC_FEATURE (11)..(11): Xaa = Asn, Arg, Lys, or Thr
  MISC_FEATURE (12)..(12): Xaa = Gln, His, or Arg
  MISC_FEATURE (13)..(13): Xaa = Lys or Gln
  MISC_FEATURE (14)..(14): Xaa = Asn, His, or Asp
  MISC_FEATURE (17)..(17): Xaa = Asn, Thr, Val
KSSXSLXXSXXXXXYLX

SEQ ID NO: 166 - protein, 9 aa, Artificial Sequence
  Synthetic construct
  MISC_FEATURE (2)..(2): Xaa = Gln, Lys, or His
  MISC_FEATURE (4)..(4): Xaa = Asn, Asp, or Arg
  MISC_FEATURE (5)..(5): Xaa = Ser or Thr
  MISC_FEATURE (8)..(8): Xaa = Leu or Met
QXYXXYPXT

SEQ ID NO: 167 - protein, 114 aa, Artificial Sequence
  Synthetic construct
QVQLQQPGAELVGPGSSVKLSCKASGYTFINYWIDWMKQSPGQGLEWIGNIYPSDSESHYNQKFTDKATLTVDISSSTAYLQLSSLTSEDSAVYYCALYSKGYWGQGTSVTVSS

SEQ ID NO: 168 - protein, 10 aa, Artificial Sequence
  Synthetic construct
GYTFINYWID

SEQ ID NO: 169 - protein, 17 aa, Artificial Sequence
  Synthetic construct
NIYPSDSESHYNQKFTD

SEQ ID NO: 170 - protein, 7 aa, Artificial Sequence
  Synthetic construct
ALYSKGY

SEQ ID NO: 171 - protein, 113 aa, Artificial Sequence
  Synthetic construct
DVLMTQTPLSLPVTLGDQASISCRSSQNIVHTNGNTYLEWYLQKPGQSPKLLIYKLSSRFSGVPDRFSGSGSGTDFTLKISRVEAEDLGVYYCFQGSHLPFTFGGGTKLEIKR

SEQ ID NO: 172 - protein, 16 aa, Artificial Sequence
  Synthetic construct
RSSQNIVHTNGNTYLE

SEQ ID NO: 173 - protein, 7 aa, Artificial Sequence
  Synthetic construct
KLSSRFS

SEQ ID NO: 174 - protein, 9 aa, Artificial Sequence
  Synthetic construct
FQGSHLPFT

SEQ ID NO: 175 - protein, 10 aa, Artificial Sequence
  Synthetic construct
  misc_feature (2)..(2): Xaa can be any naturally occurring amino acid
  misc_feature (7)..(8): Xaa can be any naturally occurring amino acid
GXTFINXXID

SEQ ID NO: 176 - protein, 16 aa, Artificial Sequence
  Synthetic construct
  misc_feature (1)..(1): Xaa can be any naturally occurring amino acid
  misc_feature (4)..(4): Xaa can be any naturally occurring amino acid
  misc_feature (10)..(10): Xaa can be any naturally occurring amino acid
XSSXNIVHTXGNTYLE

SEQ ID NO: 177 - protein, 9 aa, Artificial Sequence
  Synthetic construct
  misc_feature (2)..(2): Xaa can be any naturally occurring amino acid
  misc_feature (8)..(8): Xaa can be any naturally occurring amino acid
FXGSHLPXT

SEQ ID NO: 178 - protein, 20 aa, Artificial Sequence
  Synthetic construct
GEPPKSGDRSGYSSPGSPGT

SEQ ID NO: 179 - protein, 15 aa, Artificial Sequence
  Synthetic construct
GEPPKSGDRSGYSSP

SEQ ID NO: 180 - protein, 15 aa, Artificial Sequence
  Synthetic construct
SGDRSGYSSPGSPGT

SEQ ID NO: 181 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 182 - protein, 110 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 183 - protein, 107 aa, Artificial Sequence
  Synthetic construct
GQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 184 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGLVWVGYKTTPPVLDSDGSFFLYSKLTVAKSTWQQGWVFSCSVMHEALHNHYTQKSLSLSPGK

SEQ ID NO: 185 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTVWSHYKTTPPVLDSDGSFFLYSKLTVSKSEWQQGYVFSCSVMHEALHNHYTQKSLSLSPGK

SEQ ID NO: 186 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSQYKTTPPVLDSDGSFFLYSKLTVEKSDWQQGHVFSCSVMHEALHNHYTQKSLSLSPGK

SEQ ID NO: 187 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESVGTPWALYKTTPPVLDSDGSFFLYSKLTVLKSEWQQGWVFSCSVMHEALHNHYTQKSLSLSPGK

SEQ ID NO: 188 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTVWSKYKTTPPVLDSDGSFFLYSKLTVSKSEWQQGFVFSCSVMHEALHNHYTQKSLSLSPGK

SEQ ID NO: 189 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWAVYKTTPPVLDSDGSFFLYSKLTVPKSTWQQGWVFSCSVMHEALHNHYTQKSLSLSPGK

SEQ ID NO: 190 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGLVWVGYKTTPPVLDSDGSFFLYSKLTVPKSTWQQGWVFSCSVMHEALHNHYTQKSLSLSPGK

SEQ ID NO: 191 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESMGHVWVGYKTTPPVLDSDGSFFLYSKLTVDKSTWQQGWVFSCSVMHEALHNHYTQKSLSLSPGK

SEQ ID NO: 192 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGLVWVFSKTTPPVLDSDGSFFLYSKLTVPKSTWQQGWVFSCSVMHEALHNHYTQKSLSLSPGK

SEQ ID NO: 193 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSSYKTTPPVLDSDGSFFLYSKLTVTKSEWQQGFVFSCSVMHEALHNHYTQKSLSLSPGK

SEQ ID NO: 194 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYKTTPPVLDSDGSFFLYSKLTVSKSEWQQGFVFSCSVMHEALHNHYTQKSLSLSPGK

SEQ ID NO: 195 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVGYKTTPPVLDSDGSFFLYSKLTVSKSEWQQGWVFSCSVMHEALHNHYTQKSLSLSPGK

SEQ ID NO: 196 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVATKTTPPVLDSDGSFFLYSKLTVPKSTWQQGWVFSCSVMHEALHNHYTQKSLSLSPGK

SEQ ID NO: 197 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGPVWVHTKTTPPVLDSDGSFFLYSKLTVPKSTWQQGWVFSCSVMHEALHNHYTQKSLSLSPGK

SEQ ID NO: 198 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVDQKTTPPVLDSDGSFFLYSKLTVPKSTWQQGWVFSCSVMHEALHNHYTQKSLSLSPGK

SEQ ID NO: 199 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVNQKTTPPVLDSDGSFFLYSKLTVPKSTWQQGWVFSCSVMHEALHNHYTQKSLSLSPGK

SEQ ID NO: 200 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVNFKTTPPVLDSDGSFFLYSKLTVPKSTWQQGWVFSCSVMHEALHNHYTQKSLSLSPGK

SEQ ID NO: 201 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESLGHVWAVYKTTPPVLDSDGSFFLYSKLTVPKSTWQQGWVFSCSVMHEALHNHYTQKSLSLSPGK

SEQ ID NO: 202 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESLGHVWAVYKTTPPVLDSDGSFFLYSKLTVPKSTWQQGWVFSCSVMHEALHNHYTQKSLSLSPGK

SEQ ID NO: 203 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVYWESLGHVWAVYKTTPPVLDSDGSFFLYSKLTVPKSTWQQGWVFSCSVMHEALHNHYTQKSLSLSPGK

SEQ ID NO: 204 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWAVYQTTPPVLDSDGSFFLYSKLTVPKSTWQQGWVFSCSVMHEALHNHYTQKSLSLSPGK

SEQ ID NO: 205 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWAVYFTTPPVLDSDGSFFLYSKLTVPKSTWQQGWVFSCSVMHEALHNHYTQKSLSLSPGK

SEQ ID NO: 206 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWAVYHTTPPVLDSDGSFFLYSKLTVPKSTWQQGWVFSCSVMHEALHNHYTQKSLSLSPGK

SEQ ID NO: 207 - protein, 217 aa, Artificial Sequence; identical to SEQ ID NO: 201
  Synthetic construct

SEQ ID NO: 208 - protein, 217 aa, Artificial Sequence; identical to SEQ ID NO: 204
  Synthetic construct

SEQ ID NO: 209 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESLGHVWAVYQTTPPVLDSDGSFFLYSKLTVPKSTWQQGWVFSCSVMHEALHNHYTQKSLSLSPGK

SEQ ID NO: 210 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESLGHVWVNQKTTPPVLDSDGSFFLYSKLTVPKSTWQQGWVFSCSVMHEALHNHYTQKSLSLSPGK

SEQ ID NO: 211 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVNQQTTPPVLDSDGSFFLYSKLTVPKSTWQQGWVFSCSVMHEALHNHYTQKSLSLSPGK

SEQ ID NO: 212 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESLGHVWVNQQTTPPVLDSDGSFFLYSKLTVPKSTWQQGWVFSCSVMHEALHNHYTQKSLSLSPGK

SEQ ID NO: 213 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYKTTPPVLDSDGSFFLYSKLTVTKSEWQQGFVFSCSVMHEALHNHYTQKSLSLSPGK

SEQ ID NO: 214 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSSYKTTPPVLDSDGSFFLYSKLTVTKEEWQQGFVFSCSVMHEALHNHYTQKSLSLSPGK

SEQ ID NO: 215 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 216 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSNYKTTPPVLDSDGSFFLYSKLTVTKSEWQQGFVFSCSVMHEALHNHYTQKSLSLSPGK

SEQ ID NO: 217 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 218 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSNYKTTPPVLDSDGSFFLYSKLTVTKEEWQQGFVFSCSVMHEALHNHYTQKSLSLSPGK

SEQ ID NO: 219 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYKTTPPVLDSDGSFFLYSKLTVTKSEWQQGFVFSCSVMHEALHNHYTQKSLSLSPGK

SEQ ID NO: 220 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSSYQTTPPVLDSDGSFFLYSKLTVTKSEWQQGFVFSCSVMHEALHNHYTQKSLSLSPGK

SEQ ID NO: 221 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYQTTPPVLDSDGSFFLYSKLTVTKSEWQQGFVFSCSVMHEALHNHYTQKSLSLSPGK

SEQ ID NO: 222 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYKTTPPVLDSDGSFFLYSKLTVTKSEWQQGFVFSCSVMHEALHNHYTQKSLSLSPGK

SEQ ID NO: 223 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTKSEWQQGFVFSCSVMHEALHNHYTQKSLSLSPGK

SEQ ID NO: 224 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTREEWQQGFVFSCSVMHEALHNHYTQKSLSLSPGK

SEQ ID NO: 225 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTGEEWQQGFVFSCSVMHEALHNHYTQKSLSLSPGK

SEQ ID NO: 226 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTREEWQQGFVFSCWVMHEALHNHYTQKSLSLSPGK

SEQ ID NO: 227 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTKEEWQQGFVFSCWVMHEALHNHYTQKSLSLSPGK

SEQ ID NO: 228 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTREEWQQGFVFTCWVMHEALHNHYTQKSLSLSPGK

SEQ ID NO: 229 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTREEWQQGFVFTCGVMHEALHNHYTQKSLSLSPGK

SEQ ID NO: 230 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTREEWQQGFVFECWVMHEALHNHYTQKSLSLSPGK

SEQ ID NO: 231 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTREEWQQGFVFKCWVMHEALHNHYTQKSLSLSPGK

SEQ ID NO: 232 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTPEEWQQGFVFKCWVMHEALHNHYTQKSLSLSPGK

SEQ ID NO: 233 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYRTTPPVLDSDGSFFLYSKLTVTREEWQQGFVFSCSVMHEALHNHYTQKSLSLSPGK

SEQ ID NO: 234 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYRTTPPVLDSDGSFFLYSKLTVTGEEWQQGFVFSCSVMHEALHNHYTQKSLSLSPGK

SEQ ID NO: 235 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYRTTPPVLDSDGSFFLYSKLTVTREEWQQGFVFTCWVMHEALHNHYTQKSLSLSPGK

SEQ ID NO: 236 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYRTTPPVLDSDGSFFLYSKLTVTGEEWQQGFVFTCWVMHEALHNHYTQKSLSLSPGK

SEQ ID NO: 237 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYRTTPPVLDSDGSFFLYSKLTVTREEWQQGFVFTCGVMHEALHNHYTQKSLSLSPGK

SEQ ID NO: 238 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYKTTPPVLDSDGSFFLYSKLTVTKEEWQQGFVFSCSVMHEALHNHYTQKSLSLSPGK

SEQ ID NO: 239 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTKEEWQQGFVFSCSVMHEALHNHYTQKSLSLSPGK

SEQ ID NO: 240 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 241 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWASYKTTPPVLDSDGSFFLYSKLTVTKEEWQQGFVFSCSVMHEALHNHYTQKSLSLSPGK

SEQ ID NO: 242 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWVSYKTTPPVLDSDGSFFLYSKLTVTKEEWQQGFVFSCSVMHEALHNHYTQKSLSLSPGK

SEQ ID NO: 243 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSSYKTTPPVLDSDGSFFLYSKLTVSKEEWQQGFVFSCSVMHEALHNHYTQKSLSLSPGK

SEQ ID NO: 244 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWASYKTTPPVLDSDGSFFLYSKLTVTKEEWQQGFVFSCSVMHEALHNHYTQKSLSLSPGK

SEQ ID NO: 245 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWVSYKTTPPVLDSDGSFFLYSKLTVTKEEWQQGFVFSCSVMHEALHNHYTQKSLSLSPGK

SEQ ID NO: 246 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESFGTEWSSYKTTPPVLDSDGSFFLYSKLTVTKEEWQQGFVFSCSVMHEALHNHYTQKSLSLSPGK

SEQ ID NO: 247 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWASYKTTPPVLDSDGSFFLYSKLTVTKEEWQQGFVFSCSVMHEALHNHYTQKSLSLSPGK

SEQ ID NO: 248 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWVSYKTTPPVLDSDGSFFLYSKLTVTKEEWQQGFVFSCSVMHEALHNHYTQKSLSLSPGK

SEQ ID NO: 249 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYKTTPPVLDSDGSFFLYSKLTVSKEEWQQGFVFSCSVMHEALHNHYTQKSLSLSPGK

SEQ ID NO: 250 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESFGTEWASYKTTPPVLDSDGSFFLYSKLTVTKEEWQQGFVFSCSVMHEALHNHYTQKSLSLSPGK

SEQ ID NO: 251 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESFGTEWVSYKTTPPVLDSDGSFFLYSKLTVTKEEWQQGFVFSCSVMHEALHNHYTQKSLSLSPGK

SEQ ID NO: 252 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSNYKTTPPVLDSDGSFFLYSKLTVTKEEWQQGFVFSCSVMHEALHNHYTQKSLSLSPGK

SEQ ID NO: 253 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWANYKTTPPVLDSDGSFFLYSKLTVTKEEWQQGFVFSCSVMHEALHNHYTQKSLSLSPGK

SEQ ID NO: 254 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 255 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 256 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWANYKTTPPVLDSDGSFFLYSKLTVTKEEWQQGFVFSCSVMHEALHNHYTQKSLSLSPGK

SEQ ID NO: 257 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWVNYKTTPPVLDSDGSFFLYSKLTVTKEEWQQGFVFSCSVMHEALHNHYTQKSLSLSPGK

SEQ ID NO: 258 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESFGTEWSNYKTTPPVLDSDGSFFLYSKLTVTKEEWQQGFVFSCSVMHEALHNHYTQKSLSLSPGK

SEQ ID NO: 259 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWANYKTTPPVLDSDGSFFLYSKLTVTKEEWQQGFVFSCSVMHEALHNHYTQKSLSLSPGK

SEQ ID NO: 260 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWVNYKTTPPVLDSDGSFFLYSKLTVTKEEWQQGFVFSCSVMHEALHNHYTQKSLSLSPGK

SEQ ID NO: 261 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSNYKTTPPVLDSDGSFFLYSKLTVSKEEWQQGFVFSCSVMHEALHNHYTQKSLSLSPGK

SEQ ID NO: 262 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESFGTEWANYKTTPPVLDSDGSFFLYSKLTVTKEEWQQGFVFSCSVMHEALHNHYTQKSLSLSPGK

SEQ ID NO: 263 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESFGTEWVNYKTTPPVLDSDGSFFLYSKLTVTKEEWQQGFVFSCSVMHEALHNHYTQKSLSLSPGK

SEQ ID NO: 264 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESFGTEWSSYKTTPPVLDSDGSFFLYSKLTVTKEEWQQGFVFSCSVMHEALHNHYTQKSLSLSPGK

SEQ ID NO: 265 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWASYKTTPPVLDSDGSFFLYSKLTVTKEEWQQGFVFSCSVMHEALHNHYTQKSLSLSPGK

SEQ ID NO: 266 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWVSYKTTPPVLDSDGSFFLYSKLTVTKEEWQQGFVFSCSVMHEALHNHYTQKSLSLSPGK

SEQ ID NO: 267 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYKTTPPVLDSDGSFFLYSKLTVSKEEWQQGFVFSCSVMHEALHNHYTQKSLSLSPGK

SEQ ID NO: 268 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESFGTEWASYKTTPPVLDSDGSFFLYSKLTVTKEEWQQGFVFSCSVMHEALHNHYTQKSLSLSPGK

SEQ ID NO: 269 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESFGTEWVSYKTTPPVLDSDGSFFLYSKLTVTKEEWQQGFVFSCSVMHEALHNHYTQKSLSLSPGK

SEQ ID NO: 270 - protein, 217 aa, Artificial Sequence; identical to SEQ ID NO: 219
  Synthetic construct

SEQ ID NO: 271 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 272 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 273 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 274 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 275 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 276 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 277 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 278 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 279 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 280 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 281 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 282 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 283 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 284 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 285 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 286 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 287 - protein, 15 aa, Artificial Sequence
  Synthetic construct
EPKSCDKTHTCPPCP

SEQ ID NO: 288 - protein, 760 aa, Artificial Sequence
  Synthetic construct
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTGTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 289 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFDYVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK

SEQ ID NO: 290 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFDMVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK

SEQ ID NO: 291 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFEYVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK

SEQ ID NO: 292 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFEMVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK

SEQ ID NO: 293 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFELVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK

SEQ ID NO: 294 - protein, 217 aa, Artificial Sequence
  Synthetic construct
APELLGGPSVFLFPPKPKDTLMISRTPEVTCVVVDVSHEDPEVEFIWYVDGVDVRYEWQLPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 295 - protein, 217 aa, Artificial Sequence
  Synthetic construct
APELLGGPSVFLFPPKPKDTLMISRTPEVTCVVVDVSHEDPEVGFVWYVDGVPVSWEWYWPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 296 - protein, 217 aa, Artificial Sequence
  Synthetic construct
APELLGGPSVFLFPPKPKDTLMISRTPEVTCVVVDVSHEDPEVQFDWYVDGVMVRREWHRPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 297 - protein, 217 aa, Artificial Sequence
  Synthetic construct
APELLGGPSVFLFPPKPKDTLMISRTPEVTCVVVDVSHEDPEVSFEWYVDGVPVRWEWQWPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 298 - protein, 217 aa, Artificial Sequence
  Synthetic construct
APELLGGPSVFLFPPKPKDTLMISRTPEVTCVVVDVSHEDPEVAFTWYVDGVPVRWEWQNPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 299 - protein, 217 aa, Artificial Sequence
  Synthetic construct
APELLGGPSVFLFPPKPKDTLMISRTPEVTCVVVDPQTPPWEVKFNWYVDGVEVHNAKTKPREEEYYTYYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 300 - protein, 217 aa, Artificial Sequence
  Synthetic construct
APELLGGPSVFLFPPKPKDTLMISRTPEVTCVVVDPPSPPWEVKFNWYVDGVEVHNAKTKPREEEYYSNYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 301 - protein, 217 aa, Artificial Sequence
  Synthetic construct
APELLGGPSVFLFPPKPKDTLMISRTPEVTCVVVDPQTPPWEVKFNWYVDGVEVHNAKTKPREEEYYSNYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 302 - protein, 217 aa, Artificial Sequence
  Synthetic construct
APELLGGPSVFLFPPKPKDTLMISRTPEVTCVVVDFRGPPWEVKFNWYVDGVEVHNAKTKPREEEYYHDYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 303 - protein, 217 aa, Artificial Sequence
  Synthetic construct
APELLGGPSVFLFPPKPKDTLMISRTPEVTCVVVDPQTVPWEVKFNWYVDGVEVHNAKTKPREEEYYSNYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 304 - protein, 217 aa, Artificial Sequence
  Synthetic construct
APELLGGPSVFLFPPKPKDTLMISRTPEVTCVVVDVSVPPRMVKFNWYVDGVEVHNAKTKSLTSQHNSTVRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 305 - protein, 217 aa, Artificial Sequence
  Synthetic construct
APELLGGPSVFLFPPKPKDTLMISRTPEVTCVVVDVSVPPWMVKFNWYVDGVEVHNAKTKSLTSQHNSTVRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 306 - protein, 217 aa, Artificial Sequence
  Synthetic construct
APELLGGPSVFLFPPKPKDTLMISRTPEVTCVVVDVSDMWEYVKFNWYVDGVEVHNAKTKPWVKQLNSTWRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 307 - protein, 217 aa, Artificial Sequence
  Synthetic construct
APELLGGPSVFLFPPKPKDTLMISRTPEVTCVVVDVSDDWTWVKFNWYVDGVEVHNAKTKPWIAQPNSTWRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 308 - protein, 217 aa, Artificial Sequence
  Synthetic construct
APELLGGPSVFLFPPKPKDTLMISRTPEVTCVVVDVSDDWEWVKFNWYVDGVEVHNAKTKPWKLQLNSTWRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 309 - protein, 217 aa, Artificial Sequence
  Synthetic construct
APELLGGPSVFLFPPKPKDTLMISRTPEVTCVVVDVSHEDPWVWFYWYVDGVEVHNAKTKPREEQYNSTYRVVSVLTVLHQDWLNGKEYKCSVVNIALWWSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 310 - protein, 217 aa, Artificial Sequence
  Synthetic construct
APELLGGPSVFLFPPKPKDTLMISRTPEVTCVVVDVSHEDPVVGFRWYVDGVEVHNAKTKPREEQYNSTYRVVSVLTVLHQDWLNGKEYKCRVSNSALTWKIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 311 - protein, 217 aa, Artificial Sequence
  Synthetic construct
APELLGGPSVFLFPPKPKDTLMISRTPEVTCVVVDVSHEDPVVGFRWYVDGVEVHNAKTKPREEQYNSTYRVVSVLTVLHQDWLNGKEYKCRVSNSALSWRIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 312 - protein, 217 aa, Artificial Sequence
  Synthetic construct
APELLGGPSVFLFPPKPKDTLMISRTPEVTCVVVDVSHEDPIVGFRWYVDGVEVHNAKTKPREEQYNSTYRVVSVLTVLHQDWLNGKEYKCRVSNSALRWRIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 313 - protein, 217 aa, Artificial Sequence
  Synthetic construct
APELLGGPSVFLFPPKPKDTLMISRTPEVTCVVVDVSHEDPAVGFEWYVDGVEVHNAKTKPREEQYNSTYRVVSVLTVLHQDWLNGKEYKCQVFNWALDWVIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 314 - protein, 220 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 315 - protein, 220 aa, Artificial Sequence
  Synthetic construct
DIVMTQSPSSLTVTAGEKVTMSCKSSQSLLNSGNQKNYLTWYQQKPGQPPKLLIYWASTRESGVPDRFTGSGSGTDFTLTISNVQSEDLAEYFCQQYNSYPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 316 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 317 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 318 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 319 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 320 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 321 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 322 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 323 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 324 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 325 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 326 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 327 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 328 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 329 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 330 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 331 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 332 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 333 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 334 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 335 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 336 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 337 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 338 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 339 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 340 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESYGTEWSSYKTTPPVLDSDGSFFLYSKLTVTKEEWQQGFVFSCSVMHEALHNHYTQKSLSLSPGK

SEQ ID NO: 341 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 342 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 343 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 344 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 345 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 346 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 347 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 348 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVMHEALHNHYTQKSLSLSPGK

SEQ ID NO: 349 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVMHEALHNHYTQKSLSLSPGK

SEQ ID NO: 350 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVMHEALHNHYTQKSLSLSPGK

SEQ ID NO: 351 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVMHEALHNHYTQKSLSLSPGK

SEQ ID NO: 352 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVMHEALHNHYTQKSLSLSPGK

SEQ ID NO: 353 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVMHEALHNHYTQKSLSLSPGK

SEQ ID NO: 354 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVMHEALHNHYTQKSLSLSPGK

SEQ ID NO: 355 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVMHEALHNHYTQKSLSLSPGK

SEQ ID NO: 356 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVMHEALHNHYTQKSLSLSPGK

SEQ ID NO: 357 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVMHEALHNHYTQKSLSLSPGK

SEQ ID NO: 358 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVMHEALHNHYTQKSLSLSPGK

SEQ ID NO: 359 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVMHEALHNHYTQKSLSLSPGK

SEQ ID NO: 360 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVMHEALHNHYTQKSLSLSPGK

SEQ ID NO: 361 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVMHEALHNHYTQKSLSLSPGK

SEQ ID NO: 362 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVMHEALHNHYTQKSLSLSPGK

SEQ ID NO: 363 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVMHEALHNHYTQKSLSLSPGK

SEQ ID NO: 364 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVMHEALHNHYTQKSLSLSPGK

SEQ ID NO: 365 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVMHEALHNHYTQKSLSLSPGK

SEQ ID NO: 366 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 367 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 368 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 369 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 370 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 371 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 372 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVMHEALHNHYTQKSLSLSPGK

SEQ ID NO: 373 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVMHEALHNHYTQKSLSLSPGK

SEQ ID NO: 374 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVMHEALHNHYTQKSLSLSPGK

SEQ ID NO: 375 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVMHEALHNHYTQKSLSLSPGK

SEQ ID NO: 376 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVMHEALHNHYTQKSLSLSPGK

SEQ ID NO: 377 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVMHEALHNHYTQKSLSLSPGK

SEQ ID NO: 378 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 379 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 380 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 381 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 382 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 383 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 384 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVMHEALHNHYTQKSLSLSPGK

SEQ ID NO: 385 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVMHEALHNHYTQKSLSLSPGK

SEQ ID NO: 386 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVMHEALHNHYTQKSLSLSPGK

SEQ ID NO: 387 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVMHEALHNHYTQKSLSLSPGK

SEQ ID NO: 388 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVMHEALHNHYTQKSLSLSPGK

SEQ ID NO: 389 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVMHEALHNHYTQKSLSLSPGK

SEQ ID NO: 390 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVMHEALHNHYTQKSLSLSPGK

SEQ ID NO: 391 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVMHEALHNHYTQKSLSLSPGK

SEQ ID NO: 392 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVMHEALHNHYTQKSLSLSPGK

SEQ ID NO: 393 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVMHEALHNHYTQKSLSLSPGK

SEQ ID NO: 394 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVMHEALHNHYTQKSLSLSPGK

SEQ ID NO: 395 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVMHEALHNHYTQKSLSLSPGK

SEQ ID NO: 396 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVMHEALHNHYTQKSLSLSPGK

SEQ ID NO: 397 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVMHEALHNHYTQKSLSLSPGK

SEQ ID NO: 398 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVMHEALHNHYTQKSLSLSPGK

SEQ ID NO: 399 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVMHEALHNHYTQKSLSLSPGK

SEQ ID NO: 400 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVMHEALHNHYTQKSLSLSPGK

SEQ ID NO: 401 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVMHEALHNHYTQKSLSLSPGK

SEQ ID NO: 402 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 403 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 404 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 405 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 406 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 407 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 408 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK

SEQ ID NO: 409 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK

SEQ ID NO: 410 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK

SEQ ID NO: 411 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK

SEQ ID NO: 412 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK

SEQ ID NO: 413 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK

SEQ ID NO: 414 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 415 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWANYKTTPPVLDSDGSFFLYSKLTVTKEEWQQGFVFSCSVMHEALHNHYTQKSLSLSPGK

SEQ ID NO: 416 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 417 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 418 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWASYKTTPPVLDSDGSFFLYSKLTVTKEEWQQGFVFSCSVMHEALHNHYTQKSLSLSPGK

SEQ ID NO: 419 - protein, 443 aa, Artificial Sequence
  Synthetic construct
EVKLVESGGGLVKPGGSLKLSCAASGFTFSSYGMSWVRQTPEKRLEWVASISGDGGSYIHYADSVKGRFTISRDSAKNTLYLQMSSLRSEDTALYYCARLPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 420 - protein, 10 aa, Artificial Sequence
  Synthetic construct
GFTFSRVGVS

SEQ ID NO: 421 - protein, 10 aa, Artificial Sequence
  Synthetic construct
GFKFSSVGVS

SEQ ID NO: 422 - protein, 10 aa, Artificial Sequence
  Synthetic construct
GFKFSQVGVS

SEQ ID NO: 423 - protein, 10 aa, Artificial Sequence
  Synthetic construct
GFKFSMVGVS

SEQ ID NO: 424 - protein, 10 aa, Artificial Sequence
  Synthetic construct
GFKFSRYGVS

SEQ ID NO: 425 - protein, 10 aa, Artificial Sequence
  Synthetic construct
GFKFSRVGMS

SEQ ID NO: 426 - protein, 10 aa, Artificial Sequence
  Synthetic construct
GFTFSSVGTS

SEQ ID NO: 427 - protein, 10 aa, Artificial Sequence
  Synthetic construct
GFTFSMVGTS

SEQ ID NO: 428 - protein, 10 aa, Artificial Sequence
  Synthetic construct
GFTFSQVGTS

SEQ ID NO: 429 - protein, 10 aa, Artificial Sequence
  Synthetic construct
GFTFSLVGTS

SEQ ID NO: 430 - protein, 10 aa, Artificial Sequence
  Synthetic construct
GFTFSKVGTS

SEQ ID NO: 431 - protein, 10 aa, Artificial Sequence
  Synthetic construct
GFTFSRYGTS

SEQ ID NO: 432 - protein, 10 aa, Artificial Sequence
  Synthetic construct
GFTFSRVGMS

SEQ ID NO: 433 - protein, 10 aa, Artificial Sequence
  Synthetic construct
GFTFSGPGMS

SEQ ID NO: 434 - protein, 10 aa, Artificial Sequence
  Synthetic construct
GFQFSGPGMS

SEQ ID NO: 435 - protein, 10 aa, Artificial Sequence
  Synthetic construct
GFMFSGPGMS

SEQ ID NO: 436 - protein, 10 aa, Artificial Sequence
  Synthetic construct
GFRFSSPGMS

SEQ ID NO: 437 - protein, 10 aa, Artificial Sequence
  Synthetic construct
GFRFSGYGMS

SEQ ID NO: 438 - protein, 17 aa, Artificial Sequence
  Synthetic construct
SISGEGGSYIHYADSVK

SEQ ID NO: 439 - protein, 17 aa, Artificial Sequence
  Synthetic construct
SISGTGGSYIHYADSVK

SEQ ID NO: 440 - protein, 17 aa, Artificial Sequence
  Synthetic construct
SISGSGGSYIHYADSVK

SEQ ID NO: 441 - protein, 17 aa, Artificial Sequence
  Synthetic construct
SISGDAGSYIHYADSVK

SEQ ID NO: 442 - protein, 17 aa, Artificial Sequence
  Synthetic construct
SISGDGGSYIHYASSVK

SEQ ID NO: 443 - protein, 17 aa, Artificial Sequence
  Synthetic construct
SISGDGGSYIHYADAVK

SEQ ID NO: 444 - protein, 17 aa, Artificial Sequence
  Synthetic construct
KSSQSLLYSGNQKNYLT

SEQ ID NO: 445 - protein, 17 aa, Artificial Sequence
  Synthetic construct
KSSQSLLSSGNQKNYLT

SEQ ID NO: 446 - protein, 17 aa, Artificial Sequence
  Synthetic construct
KSSQSLLQSGNQKNYLT

SEQ ID NO: 447 - protein, 17 aa, Artificial Sequence
  Synthetic construct
KSSQSLLNAGNQKNYLT

SEQ ID NO: 448 - protein, 17 aa, Artificial Sequence
  Synthetic construct
KSSQSLVRSGTQKDYLV

SEQ ID NO: 449 - protein, 17 aa, Artificial Sequence
  Synthetic construct
KSSQSLLRSGTQKDYLV

SEQ ID NO: 450 - protein, 17 aa, Artificial Sequence
  Synthetic construct
KSSQSLHYSGTQKDYLV

SEQ ID NO: 451 - protein, 17 aa, Artificial Sequence
  Synthetic construct
KSSQSLHNSGTQKDYLV

SEQ ID NO: 452 - protein, 17 aa, Artificial Sequence
  Synthetic construct
KSSQSLHMSGTQKDYLV

SEQ ID NO: 453 - protein, 17 aa, Artificial Sequence
  Synthetic construct
KSSQSLHQSGTQKDYLV

SEQ ID NO: 454 - protein, 17 aa, Artificial Sequence
  Synthetic construct
KSSQSLHKSGTQKDYLV

SEQ ID NO: 455 - protein, 17 aa, Artificial Sequence
  Synthetic construct
KSSQSLHLSGTQKDYLV

SEQ ID NO: 456 - protein, 17 aa, Artificial Sequence
  Synthetic construct
KSSQSLHRSGNQKDYLV

SEQ ID NO: 457 - protein, 17 aa, Artificial Sequence
  Synthetic construct
KSSQSLHRSGTQKNYLV

SEQ ID NO: 458 - protein, 17 aa, Artificial Sequence
  Synthetic construct
KSSQSLHRSGTQKDYLA

SEQ ID NO: 459 - protein, 17 aa, Artificial Sequence
  Synthetic construct
KSSQSLLYSGNQKDYLV

SEQ ID NO: 460 - protein, 9 aa, Artificial Sequence
  Synthetic construct
QQYYSYPLT

SEQ ID NO: 461 - protein, 9 aa, Artificial Sequence
  Synthetic construct
QQYSSYPLT

SEQ ID NO: 462 - protein, 9 aa, Artificial Sequence
  Synthetic construct
QQYNAYPLT

SEQ ID NO: 463 - protein, 113 aa, Artificial Sequence
  Synthetic construct
DIVMTQSPDSLAVSLGERATINCKSSQSLHYSGTQKDYLVWYQQKPGQPPKLLIYWASTRESGVPDRFSGSGSGTDFTLTISSLQAEDVAVYYCQQYSSYPLTFGQGTKVEIK

SEQ ID NO: 464 - protein, 113 aa, Artificial Sequence
  Synthetic construct
DIVMTQSPDSLAVSLGERATINCKSSQSLLYSGNQKDYLVWYQQKPGQPPKLLIYWASTRESGVPDRFSGSGSGTDFTLTISSLQAEDVAVYYCQQYSSYPLTFGQGTKVEIK

SEQ ID NO: 465 - protein, 10 aa, Artificial Sequence
  Synthetic construct
  MISC_FEATURE (3)..(3): Xaa = Thr, Lys, Arg, Gln, or Met
  MISC_FEATURE (6)..(6): Xaa = Ser, Arg, Gln, Met, Leu, Lys, Gly, or Ser
  MISC_FEATURE (7)..(7): Xaa = Tyr, Val, or Pro
  MISC_FEATURE (9)..(9): Xaa = Met, Val, or Thr
GFXFSXXGXS

SEQ ID NO: 466 - protein, 17 aa, Artificial Sequence
  Synthetic construct
  MISC_FEATURE (5)..(5): Xaa = Asp, Glu, Thr, or Ser
  MISC_FEATURE (6)..(6): Xaa = Gly or Ala
  MISC_FEATURE (14)..(14): Xaa = Asp or Ser
  MISC_FEATURE (15)..(15): Xaa = Ser or Ala
SISGXXGSYIHYAXXVK

SEQ ID NO: 467 - protein, 17 aa, Artificial Sequence
  Synthetic construct
  MISC_FEATURE (7)..(7): Xaa = Leu, His, or Val
  MISC_FEATURE (8)..(8): Xaa = Asn, Tyr, Ser, Gln, Arg, Met, Lys, or Leu
  MISC_FEATURE (9)..(9): Xaa = Ser or Ala
  MISC_FEATURE (11)..(11): Xaa = Thr or Asn
  MISC_FEATURE (14)..(14): Xaa = Asn or Asp
  MISC_FEATURE (17)..(17): Xaa = Thr, Val, or Ala
KSSQSLXXXGXQKXYLX

SEQ ID NO: 468 - protein, 9 aa, Artificial Sequence
  Synthetic construct
  MISC_FEATURE (4)..(4): Xaa = Asn, Tyr, or Ser
  MISC_FEATURE (5)..(5): Xaa = Ser or Ala
QQYXXYPLT

SEQ ID NO: 469 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSSYKTTPPVLDSDGSFFLYSKLTVSKEEWQQGFVFSCSVMHEALHNHYTQKSLSLSPGK

SEQ ID NO: 470 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWANYKTTPPVLDSDGSFFLYSKLTVSKSEWQQGFVFSCSVMHEALHNHYTQKSLSLSPGK

SEQ ID NO: 471 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSNYKTTPPVLDSDGSFFLYSKLTVSKEEWQQGFVFSCSVMHEALHNHYTQKSLSLSPGK

SEQ ID NO: 472 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSSYKTTPPVLDSDGSFFLYSKLTVSKSEWQQGFVFSCSVMHEALHNHYTQKSLSLSPGK

SEQ ID NO: 473 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWVNYKTTPPVLDSDGSFFLYSKLTVSKEEWQQGFVFSCSVMHEALHNHYTQKSLSLSPGK

SEQ ID NO: 474 - protein, 217 aa, Artificial Sequence; identical to SEQ ID NO: 194
  Synthetic construct

SEQ ID NO: 475 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWVNYKTTPPVLDSDGSFFLYSKLTVSKEEWQQGFVFSCSVMHEALHNHYTQKSLSLSPGK

SEQ ID NO: 476 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 477 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 478 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 479 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 480 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVMHEALHNHYTQKSLSLSPGK

SEQ ID NO: 481 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVMHEALHNHYTQKSLSLSPGK

SEQ ID NO: 482 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVMHEALHNHYTQKSLSLSPGK

SEQ ID NO: 483 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVMHEALHNHYTQKSLSLSPGK

SEQ ID NO: 484 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVMHEALHNHYTQKSLSLSPGK

SEQ ID NO: 485 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVMHEALHNHYTQKSLSLSPGK

SEQ ID NO: 486 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVMHEALHNHYTQKSLSLSPGK

SEQ ID NO: 487 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVMHEALHNHYTQKSLSLSPGK

SEQ ID NO: 488 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVMHEALHNHYTQKSLSLSPGK

SEQ ID NO: 489 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVMHEALHNHYTQKSLSLSPGK

SEQ ID NO: 490 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVMHEALHNHYTQKSLSLSPGK

SEQ ID NO: 491 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVMHEALHNHYTQKSLSLSPGK

SEQ ID NO: 492 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVMHEALHNHYTQKSLSLSPGK

SEQ ID NO: 493 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVMHEALHNHYTQKSLSLSPGK

SEQ ID NO: 494 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVMHEALHNHYTQKSLSLSPGK

SEQ ID NO: 495 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVMHEALHNHYTQKSLSLSPGK

SEQ ID NO: 496 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVMHEALHNHYTQKSLSLSPGK

SEQ ID NO: 497 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVMHEALHNHYTQKSLSLSPGK

SEQ ID NO: 498 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVMHEALHNHYTQKSLSLSPGK

SEQ ID NO: 499 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVMHEALHNHYTQKSLSLSPGK

SEQ ID NO: 500 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVMHEALHNHYTQKSLSLSPGK

SEQ ID NO: 501 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVMHEALHNHYTQKSLSLSPGK

SEQ ID NO: 502 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVMHEALHNHYTQKSLSLSPGK

SEQ ID NO: 503 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVMHEALHNHYTQKSLSLSPGK

SEQ ID NO: 504 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVMHEALHNHYTQKSLSLSPGK

SEQ ID NO: 505 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVMHEALHNHYTQKSLSLSPGK

SEQ ID NO: 506 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVMHEALHNHYTQKSLSLSPGK

SEQ ID NO: 507 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVMHEALHNHYTQKSLSLSPGK

SEQ ID NO: 508 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVMHEALHNHYTQKSLSLSPGK

SEQ ID NO: 509 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVMHEALHNHYTQKSLSLSPGK

SEQ ID NO: 510 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVMHEALHNHYTQKSLSLSPGK

SEQ ID NO: 511 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVMHEALHNHYTQKSLSLSPGK

SEQ ID NO: 512 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVMHEALHNHYTQKSLSLSPGK

SEQ ID NO: 513 - protein, 217 aa, Artificial Sequence
  Synthetic construct
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVMHEALHNHYTQKSLSLSPGK

SEQ ID NO: 514 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVMHEALHNHYTQKSLSLSPGK

SEQ ID NO: 515 - protein, 217 aa, Artificial Sequence
  Synthetic construct
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVMHEALHNHYTQKSLSLSPGK

SEQ ID NO: 516 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSSYKTTPPVLDSDGSFFLYSKLTVTKEEWQQGFVFSCSVLHEALHSHYTQKSLSLSPGK

SEQ ID NO: 517 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVLHEALHSHYTQKSLSLSPGK

SEQ ID NO: 518 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVLHEALHSHYTQKSLSLSPGK

SEQ ID NO: 519 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVLHEALHSHYTQKSLSLSPGK

SEQ ID NO: 520 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVLHEALHSHYTQKSLSLSPGK

SEQ ID NO: 521 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVLHEALHSHYTQKSLSLSPGK

SEQ ID NO: 522 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVLHEALHSHYTQKSLSLSPGK

SEQ ID NO: 523 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWANYKTTPPVLDSDGSFFLYSKLTVTKEEWQQGFVFSCSVLHEALHSHYTQKSLSLSPGK

SEQ ID NO: 524 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVLHEALHSHYTQKSLSLSPGK

SEQ ID NO: 525 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVLHEALHSHYTQKSLSLSPGK

SEQ ID NO: 526 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVLHEALHSHYTQKSLSLSPGK

SEQ ID NO: 527 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVLHEALHSHYTQKSLSLSPGK

SEQ ID NO: 528 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVLHEALHSHYTQKSLSLSPGK

SEQ ID NO: 529 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVLHEALHSHYTQKSLSLSPGK

SEQ ID NO: 530 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWVNYKTTPPVLDSDGSFFLYSKLTVTKEEWQQGFVFSCSVLHEALHSHYTQKSLSLSPGK

SEQ ID NO: 531 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVLHEALHSHYTQKSLSLSPGK

SEQ ID NO: 532 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVLHEALHSHYTQKSLSLSPGK

SEQ ID NO: 533 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVLHEALHSHYTQKSLSLSPGK

SEQ ID NO: 534 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVLHEALHSHYTQKSLSLSPGK

SEQ ID NO: 535 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVLHEALHSHYTQKSLSLSPGK

SEQ ID NO: 536 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVLHEALHSHYTQKSLSLSPGK

SEQ ID NO: 537 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYKTTPPVLDSDGSFFLYSKLTVSKEEWQQGFVFSCSVLHEALHSHYTQKSLSLSPGK

SEQ ID NO: 538 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVLHEALHSHYTQKSLSLSPGK

SEQ ID NO: 539 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVLHEALHSHYTQKSLSLSPGK

SEQ ID NO: 540 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVLHEALHSHYTQKSLSLSPGK

SEQ ID NO: 541 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVLHEALHSHYTQKSLSLSPGK

SEQ ID NO: 542 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVLHEALHSHYTQKSLSLSPGK

SEQ ID NO: 543 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVLHEALHSHYTQKSLSLSPGK

SEQ ID NO: 544 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWASYKTTPPVLDSDGSFFLYSKLTVTKEEWQQGFVFSCSVLHEALHSHYTQKSLSLSPGK

SEQ ID NO: 545 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVLHEALHSHYTQKSLSLSPGK

SEQ ID NO: 546 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVLHEALHSHYTQKSLSLSPGK

SEQ ID NO: 547 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVLHEALHSHYTQKSLSLSPGK

SEQ ID NO: 548 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVLHEALHSHYTQKSLSLSPGK

SEQ ID NO: 549 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVLHEALHSHYTQKSLSLSPGK

SEQ ID NO: 550 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVLHEALHSHYTQKSLSLSPGK

SEQ ID NO: 551 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYKTTPPVLDSDGSFFLYSKLTVTKEEWQQGFVFSCSVLHEALHSHYTQKSLSLSPGK

SEQ ID NO: 552 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVLHEALHSHYTQKSLSLSPGK

SEQ ID NO: 553 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVLHEALHSHYTQKSLSLSPGK

SEQ ID NO: 554 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVLHEALHSHYTQKSLSLSPGK

SEQ ID NO: 555 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVLHEALHSHYTQKSLSLSPGK

SEQ ID NO: 556 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVLHEALHSHYTQKSLSLSPGK

SEQ ID NO: 557 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVLHEALHSHYTQKSLSLSPGK

SEQ ID NO: 558 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYKTTPPVLDSDGSFFLYSKLTVTKEEWQQGFVFSCSVLHEALHSHYTQKSLSLSPGK

SEQ ID NO: 559 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVLHEALHSHYTQKSLSLSPGK

SEQ ID NO: 560 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVLHEALHSHYTQKSLSLSPGK

SEQ ID NO: 561 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVLHEALHSHYTQKSLSLSPGK

SEQ ID NO: 562 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVLHEALHSHYTQKSLSLSPGK

SEQ ID NO: 563 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVLHEALHSHYTQKSLSLSPGK

SEQ ID NO: 564 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVLHEALHSHYTQKSLSLSPGK

SEQ ID NO: 565 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSSYKTTPPVLDSDGSFFLYSKLTVSKEEWQQGFVFSCSVLHEALHSHYTQKSLSLSPGK

SEQ ID NO: 566 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVLHEALHSHYTQKSLSLSPGK

SEQ ID NO: 567 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVLHEALHSHYTQKSLSLSPGK

SEQ ID NO: 568 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVLHEALHSHYTQKSLSLSPGK

SEQ ID NO: 569 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVLHEALHSHYTQKSLSLSPGK

SEQ ID NO: 570 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVLHEALHSHYTQKSLSLSPGK

SEQ ID NO: 571 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVLHEALHSHYTQKSLSLSPGK

SEQ ID NO: 572 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWANYKTTPPVLDSDGSFFLYSKLTVSKSEWQQGFVFSCSVLHEALHSHYTQKSLSLSPGK

SEQ ID NO: 573 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVLHEALHSHYTQKSLSLSPGK

SEQ ID NO: 574 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVLHEALHSHYTQKSLSLSPGK

SEQ ID NO: 575 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVLHEALHSHYTQKSLSLSPGK

SEQ ID NO: 576 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVLHEALHSHYTQKSLSLSPGK

SEQ ID NO: 577 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVLHEALHSHYTQKSLSLSPGK

SEQ ID NO: 578 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVLHEALHSHYTQKSLSLSPGK

SEQ ID NO: 579 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSNYKTTPPVLDSDGSFFLYSKLTVSKEEWQQGFVFSCSVLHEALHSHYTQKSLSLSPGK

SEQ ID NO: 580 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVLHEALHSHYTQKSLSLSPGK

SEQ ID NO: 581 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVLHEALHSHYTQKSLSLSPGK

SEQ ID NO: 582 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVLHEALHSHYTQKSLSLSPGK

SEQ ID NO: 583 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVLHEALHSHYTQKSLSLSPGK

SEQ ID NO: 584 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVLHEALHSHYTQKSLSLSPGK

SEQ ID NO: 585 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVLHEALHSHYTQKSLSLSPGK

SEQ ID NO: 586 - protein, 10 aa, Artificial Sequence
  Synthetic construct
GFTFSQVGMS

SEQ ID NO: 587 - protein, 10 aa, Artificial Sequence
  Synthetic construct
GFKFSGPGMS

SEQ ID NO: 588 - protein, 18 aa, Artificial Sequence
  Synthetic construct
SISGDGGSYIHYADSVKG

SEQ ID NO: 589 - protein, 113 aa, Artificial Sequence
  Synthetic construct
EVQLLESGGGLVQPGGSLRLSCAASGFTFSRVGTSWVRQAPGKGLEWVASISGDGGSYIHYADSVKGRFTISRDNSKNTLYLQMNSLRAEDTAVYYCARLPYWGQGTLVTVSS

SEQ ID NO: 590 - protein, 113 aa, Artificial Sequence
  Synthetic construct
EVQLLESGGGLVQPGGSLRLSCAASGFTFSSVGTSWVRQAPGKGLEWVASISGDGGSYIHYADSVKGRFTISRDNSKNTLYLQMNSLRAEDTAVYYCARLPYWGQGTLVTVSS

SEQ ID NO: 591 - protein, 113 aa, Artificial Sequence
  Synthetic construct
EVQLLESGGGLVQPGGSLRLSCAASGFTFSMVGTSWVRQAPGKGLEWVASISGDGGSYIHYADSVKGRFTISRDNSKNTLYLQMNSLRAEDTAVYYCARLPYWGQGTLVTVSS

SEQ ID NO: 592 - protein, 113 aa, Artificial Sequence
  Synthetic construct
EVQLLESGGGLVQPGGSLRLSCAASGFTFSQVGTSWVRQAPGKGLEWVASISGDGGSYIHYADSVKGRFTISRDNSKNTLYLQMNSLRAEDTAVYYCARLPYWGQGTLVTVSS

SEQ ID NO: 593 - protein, 113 aa, Artificial Sequence
  Synthetic construct
EVQLLESGGGLVQPGGSLRLSCAASGFTFSLVGTSWVRQAPGKGLEWVASISGDGGSYIHYADSVKGRFTISRDNSKNTLYLQMNSLRAEDTAVYYCARLPYWGQGTLVTVSS

SEQ ID NO: 594 - protein, 113 aa, Artificial Sequence
  Synthetic construct
EVQLLESGGGLVQPGGSLRLSCAASGFTFSKVGTSWVRQAPGKGLEWVASISGDGGSYIHYADSVKGRFTISRDNSKNTLYLQMNSLRAEDTAVYYCARLPYWGQGTLVTVSS

SEQ ID NO: 595 - protein, 113 aa, Artificial Sequence
  Synthetic construct
EVQLLESGGGLVQPGGSLRLSCAASGFTFSRVGMSWVRQAPGKGLEWVASISGDGGSYIHYADSVKGRFTISRDNSKNTLYLQMNSLRAEDTAVYYCARLPYWGQGTLVTVSS

SEQ ID NO: 596 - protein, 113 aa, Artificial Sequence
  Synthetic construct
EVQLLESGGGLVQPGGSLRLSCAASGFRFSGPGMSWVRQAPGKGLEWVASISGDGGSYIHYADSVKGRFTISRDNSKNTLYLQMNSLRAEDTAVYYCARLPYWGQGTLVTVSS

SEQ ID NO: 597 - protein, 113 aa, Artificial Sequence
  Synthetic construct
EVQLLESGGGLVQPGGSLRLSCAASGFTFSGPGMSWVRQAPGKGLEWVASISGDGGSYIHYADSVKGRFTISRDNSKNTLYLQMNSLRAEDTAVYYCARLPYWGQGTLVTVSS

SEQ ID NO: 598 - protein, 113 aa, Artificial Sequence
  Synthetic construct
EVQLLESGGGLVQPGGSLRLSCAASGFQFSGPGMSWVRQAPGKGLEWVASISGDGGSYIHYADSVKGRFTISRDNSKNTLYLQMNSLRAEDTAVYYCARLPYWGQGTLVTVSS

SEQ ID NO: 599 - protein, 113 aa, Artificial Sequence
  Synthetic construct
EVQLLESGGGLVQPGGSLRLSCAASGFMFSGPGMSWVRQAPGKGLEWVASISGDGGSYIHYADSVKGRFTISRDNSKNTLYLQMNSLRAEDTAVYYCARLPYWGQGTLVTVSS

SEQ ID NO: 600 - protein, 113 aa, Artificial Sequence
  Synthetic construct
EVQLLESGGGLVQPGGSLRLSCAASGFRFSSPGMSWVRQAPGKGLEWVASISGDGGSYIHYADSVKGRFTISRDNSKNTLYLQMNSLRAEDTAVYYCARLPYWGQGTLVTVSS

SEQ ID NO: 601 - protein, 113 aa, Artificial Sequence
  Synthetic construct
EVQLLESGGGLVQPGGSLRLSCAASGFRFSGYGMSWVRQAPGKGLEWVASISGDGGSYIHYADSVKGRFTISRDNSKNTLYLQMNSLRAEDTAVYYCARLPYWGQGTLVTVSS

SEQ ID NO: 602 - protein, 113 aa, Artificial Sequence
  Synthetic construct
EVQLLESGGGLVQPGGSLRLSCAASGFTFSQVGMSWVRQAPGKGLEWVASISGDGGSYIHYADSVKGRFTISRDNSKNTLYLQMNSLRAEDTAVYYCARLPYWGQGTLVTVSS

SEQ ID NO: 603 - protein, 113 aa, Artificial Sequence
  Synthetic construct
EVQLLESGGGLVQPGGSLRLSCAASGFKFSGPGMSWVRQAPGKGLEWVASISGDGGSYIHYADSVKGRFTISRDNSKNTLYLQMNSLRAEDTAVYYCARLPYWGQGTLVTVSS

SEQ ID NO: 604 - protein, 113 aa, Artificial Sequence
  Synthetic construct
DIVMTQSPDSLAVSLGERATINCKSSQSLHRSGTQKDYLVWYQQKPGQPPKLLIYWASTRESGVPDRFSGSGSGTDFTLTISSLQAEDVAVYYCQQYNSYPLTFGQGTKVEIK

SEQ ID NO: 605 - protein, 113 aa, Artificial Sequence
  Synthetic construct
DIVMTQSPDSLAVSLGERATINCKSSQSLVRSGTQKDYLVWYQQKPGQPPKLLIYWASTRESGVPDRFSGSGSGTDFTLTISSLQAEDVAVYYCQQYNSYPLTFGQGTKVEIK

SEQ ID NO: 606 - protein, 113 aa, Artificial Sequence
  Synthetic construct
DIVMTQSPDSLAVSLGERATINCKSSQSLLRSGTQKDYLVWYQQKPGQPPKLLIYWASTRESGVPDRFSGSGSGTDFTLTISSLQAEDVAVYYCQQYNSYPLTFGQGTKVEIK

SEQ ID NO: 607 - protein, 113 aa, Artificial Sequence
  Synthetic construct
DIVMTQSPDSLAVSLGERATINCKSSQSLHYSGTQKDYLVWYQQKPGQPPKLLIYWASTRESGVPDRFSGSGSGTDFTLTISSLQAEDVAVYYCQQYNSYPLTFGQGTKVEIK

SEQ ID NO: 608 - protein, 113 aa, Artificial Sequence
  Synthetic construct
DIVMTQSPDSLAVSLGERATINCKSSQSLHNSGTQKDYLVWYQQKPGQPPKLLIYWASTRESGVPDRFSGSGSGTDFTLTISSLQAEDVAVYYCQQYNSYPLTFGQGTKVEIK

SEQ ID NO: 609 - protein, 113 aa, Artificial Sequence
  Synthetic construct
DIVMTQSPDSLAVSLGERATINCKSSQSLHMSGTQKDYLVWYQQKPGQPPKLLIYWASTRESGVPDRFSGSGSGTDFTLTISSLQAEDVAVYYCQQYNSYPLTFGQGTKVEIK

SEQ ID NO: 610 - protein, 113 aa, Artificial Sequence
  Synthetic construct
DIVMTQSPDSLAVSLGERATINCKSSQSLHQSGTQKDYLVWYQQKPGQPPKLLIYWASTRESGVPDRFSGSGSGTDFTLTISSLQAEDVAVYYCQQYNSYPLTFGQGTKVEIK

SEQ ID NO: 611 - protein, 113 aa, Artificial Sequence
  Synthetic construct
DIVMTQSPDSLAVSLGERATINCKSSQSLHKSGTQKDYLVWYQQKPGQPPKLLIYWASTRESGVPDRFSGSGSGTDFTLTISSLQAEDVAVYYCQQYNSYPLTFGQGTKVEIK

SEQ ID NO: 612 - protein, 113 aa, Artificial Sequence
  Synthetic construct
DIVMTQSPDSLAVSLGERATINCKSSQSLHLSGTQKDYLVWYQQKPGQPPKLLIYWASTRESGVPDRFSGSGSGTDFTLTISSLQAEDVAVYYCQQYNSYPLTFGQGTKVEIK

SEQ ID NO: 613 - protein, 113 aa, Artificial Sequence
  Synthetic construct
DIVMTQSPDSLAVSLGERATINCKSSQSLHRSGNQKDYLVWYQQKPGQPPKLLIYWASTRESGVPDRFSGSGSGTDFTLTISSLQAEDVAVYYCQQYNSYPLTFGQGTKVEIK

SEQ ID NO: 614 - protein, 113 aa, Artificial Sequence
  Synthetic construct
DIVMTQSPDSLAVSLGERATINCKSSQSLHRSGTQKNYLVWYQQKPGQPPKLLIYWASTRESGVPDRFSGSGSGTDFTLTISSLQAEDVAVYYCQQYNSYPLTFGQGTKVEIK

SEQ ID NO: 615 - protein, 113 aa, Artificial Sequence
  Synthetic construct
DIVMTQSPDSLAVSLGERATINCKSSQSLHRSGTQKDYLAWYQQKPGQPPKLLIYWASTRESGVPDRFSGSGSGTDFTLTISSLQAEDVAVYYCQQYNSYPLTFGQGTKVEIK

SEQ ID NO: 616 - protein, 113 aa, Artificial Sequence
  Synthetic construct
DIVMTQSPDSLAVSLGERATINCKSSQSLHRSGTQKDYLVWYQQKPGQPPKLLIYWASTRESGVPDRFSGSGSGTDFTLTISSLQAEDVAVYYCQQYSSYPLTFGQGTKVEIK

SEQ ID NO: 617 - protein, 10 aa, Artificial Sequence
  Synthetic construct
  MISC_FEATURE (1)..(1): Xaa = Gly or Val
  MISC_FEATURE (2)..(2): Xaa = Phe or Ile
  MISC_FEATURE (3)..(3): Xaa = Thr, Lys, Arg, Gln, or Met
  MISC_FEATURE (4)..(4): Xaa = Phe or Trp
  MISC_FEATURE (5)..(5): Xaa = Ser or Arg
  MISC_FEATURE (6)..(6): Xaa = Ser, Arg, Gly, Ile, Gln, Met, Leu, or Lys
  MISC_FEATURE (7)..(7): Xaa = Tyr, Val, or Pro
  MISC_FEATURE (9)..(9): Xaa = Met, Val, or Thr
XXXXXXXGXS

SEQ ID NO: 618 - protein, 17 aa, Artificial Sequence
  Synthetic construct
  MISC_FEATURE (4)..(4): Xaa = Gln or His
  MISC_FEATURE (7)..(7): Xaa = Leu, Tyr, His, or Val
  MISC_FEATURE (8)..(8): Xaa = Asn, Ser, Arg, Tyr, Gln, Met, Lys, or Leu
  MISC_FEATURE (9)..(9): Xaa = Ser or Ala
  MISC_FEATURE (10)..(10): Xaa = Gly or Arg
  MISC_FEATURE (11)..(11): Xaa = Asn, Arg, Lys, or Thr
  MISC_FEATURE (12)..(12): Xaa = Gln, His, or Arg
  MISC_FEATURE (13)..(13): Xaa = Lys or Gln
  MISC_FEATURE (14)..(14): Xaa = Asn, His, or Asp
  MISC_FEATURE (17)..(17): Xaa = Thr, Ala, or Val
KSSXSLXXXXXXXXYLX

SEQ ID NO: 619 - protein, 9 aa, Artificial Sequence
  Synthetic construct
  MISC_FEATURE (2)..(2): Xaa = Gln, Lys, or His
  MISC_FEATURE (4)..(4): Xaa = Asn, Asp, Arg, Tyr, or Ser
  MISC_FEATURE (5)..(5): Xaa = Ser, Thr, or Ala
  MISC_FEATURE (8)..(8): Xaa = Leu or Met
QXYXXYPXT

SEQ ID NO: 620 - protein, 10 aa, Artificial Sequence
  Synthetic construct
  MISC_FEATURE (1)..(1): Xaa = Gly, Val, or Arg
  MISC_FEATURE (2)..(2): Xaa = Phe or Ile
  MISC_FEATURE (3)..(3): Xaa = Thr, Lys, Arg, Gln, Met, or Asn
  MISC_FEATURE (4)..(4): Xaa = Phe, Trp, or Ile
  MISC_FEATURE (5)..(5): Xaa = Ser, Arg, Glu, or Lys
  MISC_FEATURE (6)..(6): Xaa = Ser, Arg, Gly, Ile, Gln, Met, Leu, Lys, or Asp
  MISC_FEATURE (7)..(7): Xaa = Tyr, Val, Pro, or Asp
  MISC_FEATURE (8)..(8): Xaa = Gly or Tyr
  MISC_FEATURE (9)..(9): Xaa = Met, Val, or Thr
  MISC_FEATURE (10)..(10): Xaa = Ser or His
XXXXXXXXXX

SEQ ID NO: 621 - protein, 17 aa, Artificial Sequence
  Synthetic construct
  MISC_FEATURE (5)..(5): Xaa = Asp, Glu, Thr, or Ser
  MISC_FEATURE (6)..(6): Xaa = Gly or Ala
  MISC_FEATURE (11)..(11): Xaa = His or Arg
  MISC_FEATURE (14)..(14): Xaa = Asp or Ser
  MISC_FEATURE (15)..(15): Xaa = Ser or Ala
SISGXXGSYIXYAXXVK

SEQ ID NO: 622 - protein, 5 aa, Artificial Sequence
  Synthetic construct
  MISC_FEATURE (1)..(1): Xaa = Ala, Thr,or Asn
  MISC_FEATURE (2)..(2): Xaa = Arg, Lys, or Thr
  MISC_FEATURE (4)..(4): Xaa = Pro or Arg
  MISC_FEATURE (5)..(5): Xaa = Tyr or Phe
XXLXX

SEQ ID NO: 623 - protein, 7 aa, Artificial Sequence
  Synthetic construct
  MISC_FEATURE (1)..(1): Xaa = Ser, Trp, Arg, or Leu
  MISC_FEATURE (2)..(2): Xaa = Ala, Met, or Val
  MISC_FEATURE (4)..(4): Xaa = Tyr, Thr, Phe, Asn, or Lys
  MISC_FEATURE (5)..(5): Xaa = Arg, Leu, or Lys
  MISC_FEATURE (6)..(6): Xaa = Tyr, His, Ala, or Glu
  MISC_FEATURE (7)..(7): Xaa = Ser or Thr
XXSXXXX

SEQ ID NO: 624 - protein, 9 aa, Artificial Sequence
  Synthetic construct
  MISC_FEATURE (1)..(1): Xaa = Gln, Ala, Val, or Pro
  MISC_FEATURE (2)..(2): Xaa = Gln, Lys, His, or Leu
  MISC_FEATURE (3)..(3): Xaa = Tyr, Met, Gly, or Ser
  MISC_FEATURE (4)..(4): Xaa = Asn, Asp, Arg, Tyr, Ser, Leu, or Thr
  MISC_FEATURE (5)..(5): Xaa = Ser, Thr, Ala, Glu, or His
  MISC_FEATURE (6)..(6): Xaa = Tyr, Arg, Phe, or Asp
  MISC_FEATURE (8)..(8): Xaa = Leu, Met, or Tyr
XXXXXXPXT

SEQ ID NO: 625 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 626 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVLHEALHSHYTQKSLSLSPGK

SEQ ID NO: 627 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVLHEALHSHYTQKSLSLSPGK

SEQ ID NO: 628 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVLHEALHSHYTQKSLSLSPGK

SEQ ID NO: 629 - protein, 217 aa, Artificial Sequence
  Synthetic construct
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVLHEALHSHYTQKSLSLSPGK

SEQ ID NO: 630 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVLHEALHSHYTQKSLSLSPGK

SEQ ID NO: 631 - protein, 217 aa, Artificial Sequence
  Synthetic construct
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVLHEALHSHYTQKSLSLSPGK

SEQ ID NO: 632 - protein, 5 aa, Artificial Sequence
  Synthetic construct
AAGHV

SEQ ID NO: 633 - protein, 7 aa, Artificial Sequence
  Synthetic construct
  MISC_FEATURE (4)..(4): Xaa = Thr or Tyr
  MISC_FEATURE (6)..(6): Xaa = Glu or Tyr
WASXRXS

SEQ ID NO: 634 - protein, 9 aa, Artificial Sequence
  Synthetic construct
  MISC_FEATURE (4)..(4): Xaa = Asn or Ser
  MISC_FEATURE (5)..(5): Xaa = Ser or Thr
QQYXXYPLT

SEQ ID NO: 635 - protein, 7 aa, Artificial Sequence
  Synthetic construct
  misc_feature (2)..(2): Xaa can be any naturally occurring amino acid
YXTEWSS

SEQ ID NO: 636 - protein, 9 aa, Artificial Sequence
  Synthetic construct
  misc_feature (2)..(3): Xaa can be any naturally occurring amino acid
  misc_feature (5)..(8): Xaa can be any naturally occurring amino acid
TXXEXXXXF

SEQ ID NO: 637 - protein, 114 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPFTFGQGTKVEIKR

SEQ ID NO: 638 - protein, 112 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPFGQGTKVEIKR

SEQ ID NO: 639 - DNA, 342 bp, Artificial Sequence
  Description of Artificial Sequence: Synthetic polynucleotide
gacatcgtgatgacccagagcccagacagcctggccgtgagcctgggcgagcgcgccaccatcaactgcaagagcagccagagcctgctgaacagcggcaaccagaagaactacctgacctggtaccagcagaagccaggccagccaccaaagctgctgatctactgggccagcacccgcgagagcggcgtgccagaccgcttcagcggcagcggcagcggcaccgacttcaccctgaccatcagcagcctgcaggccgaggacgtggccgtgtactactgccagcagtagaacagctacccactgaccttcggccagggcaccaaggtggagatcaagcgc

SEQ ID NO: 640 - protein, 112 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKFDYWGQGTLVTVSS

SEQ ID NO: 641 - DNA, 339 bp, Artificial Sequence
  Description of Artificial Sequence: Synthetic polynucleotide
gaggtgcagctgctggagagcggcggcggcctggtgcagccaggcggcagcctgcgcctgagctgcgccgccagcggcttcaccttcagcagctacggcatgagctgggtgcgccaggccccaggcaagggcctggagtgggtggccagcatcagcggcgacggcggcagctacatccactacgccgacagcgtgaagggccgcttcaccatcagccgcgacaacagcaagaacaccctgtacctgcagatgaacagcctgcgcgccgaggacaccgccgtgtactactgcgcccgcctgccatactggggccagggcaccctggtgaccgtgagcagc

SEQ ID NO: 642 - protein, 112 aa, Artificial Sequence
  Description of Artificial Sequence: Synthetic polypeptide
DIVMTQTPLSLSVTPGQPASISCKSSQSLLHSDGKTYLYWYLQKPGQSPQLLIYEVSSRFSGVPDRFSGSGSGTDFTLKISRVEAEDVGVYYMQGIHLPFTFGQGTKVEIKR

SEQ ID NO: 643 - protein, 111 aa, Artificial Sequence
  Description of Artificial Sequence: Synthetic polypeptide
DIVMTQTPLSLPVTPGQPASISCRSSQSLLHSSGNTYLDWYLQKPGQSPQLLIYLGSNRASGVPDRFSGSGSGTDFTLKISRVEAEDVGVYYCQQAIQFPFGQGTKVEIKR

SEQ ID NO: 644 - protein, 113 aa, Artificial Sequence
  Description of Artificial Sequence: Synthetic polypeptide
DIVMTQTPLSLPVTPGQPASISCKSSQSLLYSDGKTYLNWYLQKPGQSPQLLIYLVSKLESGVPDRFSGSGSGTDFTLKISRVEAEDVGVYYCVQGTHFPFTFGQGTKVEIKR

SEQ ID NO: 645 - DNA, 339 bp, Artificial Sequence
  Description of Artificial Sequence: Synthetic polynucleotide
gacatcgtgatgacccagaccccactgagcctgccagtgaccccaggccagccagccagcatcagctgcaagagcagccagagcctgctgtacagcgacggcaagacctacctgaactggtacctgcagaagccaggccagagcccacagctgctgatctacctggtgagcaagctggagagcggcgtgccagaccgcttcagcggcagcggcagcggcaccgacttcaccctgaagatcagccgcgtggaggccgaggacgtgggcgtgtactactgcgtgcagggcacccacttcccattcaccttcggccagggcaccaaggtggagatcaagcgc

SEQ ID NO: 646 - protein, 112 aa, Artificial Sequence
  Description of Artificial Sequence: Synthetic polypeptide
EVQLVQSGAEVKKPGATVKISCKVSGYTFTDYYMHWVQQAPGKGLEWMGLVDPEDGETIYAEKFQGRVTITADTSTDTAYMELSSLRSEDTAVYYCATFDYWGQGTLVTVSS

SEQ ID NO: 647 - protein, 115 aa, Artificial Sequence
  Description of Artificial Sequence: Synthetic polypeptide
EVQLVQSGAEVKKPGATVKISCKVSGFNIKDSLMHWVQQAPGKGLEWMGWIDPEDGETKYAPKFQDRVTITADTSTDTAYMELSSLRSEDTAVYYCTRRDWEGPWGQGTLVTVSS

SEQ ID NO: 648 - DNA, 345 bp, Artificial Sequence
  Description of Artificial Sequence: Synthetic polynucleotide
gacgtgcagctggtgcagagcggcgccgaggtgaagaagccaggcgccgccgtgaagatcagctgcaaggtgagcggcttcaacatcaaggacagcctgatgcactgggtgcagcaggccccaggcaagggcctggagtggatgggctggatcgacccagaggacggcgagaccaagtacgccccaaagttccaggaccgcgtgaccatcaccgccgacaccagcaccgacaccgcctacatggagctgagcagcctgcgcagcgaggacaccgccgtgtactactgcacccgccgcgactgggagggcccatggggccagggcaccctggtgaccgtgagcagc

SEQ ID NO: 649 - protein, 113 aa, Artificial Sequence
  Description of Artificial Sequence: Synthetic polypeptide
DIVMTQTPLSLPVTPGQPASISCKSSQSLLYSDGKTYLNWYLQKPGQSPQLLIYLVSKLESGVPDRFSGSGSGTDFTLKISRVEAEDVGVYYCVQGTHFPYTFGQGTKVEIKR

SEQ ID NO: 650 - DNA, 339 bp, Artificial Sequence
  Description of Artificial Sequence: Synthetic polynucleotide
gacatcgtgatgacccagaccccactgagcctgccagtgaccccaggccagccagccagcatcagctgcaagagcagccagagcctgctgtacagcgacggcaagacctacctgaactggtacctgcagaagccaggccagagcccacagctgctgatctacctggtgagcaagctggagagcggcgtgccagaccgcttcagcggcagcggcagcggcaccgacttcaccctgaagatcagccgcgtggaggccgaggacgtgggcgtgtactactgcgtgcagggcacccacttcccatacaccttcggccagggcaccaaggtggagatcaagcgc

SEQ ID NO: 651 - protein, 114 aa, Artificial Sequence
  Description of Artificial Sequence: Synthetic polypeptide
EVQLVQSGAEVKKPGATVKISCKVSGFNIKDSLIHWVQQAPGKGLEWMGWIDPEDGETKYAPKFQDRVTITADTSTDTAYMELSSLRSEDTAVYYCASGEWDYWGQGTLVTVSS

SEQ ID NO: 652 - DNA, 342 bp, Artificial Sequence
  Description of Artificial Sequence: Synthetic polynucleotide
gaggtccagctggtgcagagcggcgccgaggtgaagaagccaggcgccaccgtgaagatcagctgcaaggtgagcggcttcaacatcaaggacagcctgatccactgggtgcagcaggccccaggcaagggcctggagtggatgggctggactgacccagaggacggcgagaccaagtacgccccaaagttccaggaccgcgtgaccatcaccgccgacaccagcaccgacaccgcctacatggagctgagcagcctgcgcagcgaggacaccgccgtgtactactgcgccagcggcgagtgggactactggggccagggcaccctggtgaccgtgagcagc

SEQ ID NO: 653 - DNA, 339 bp, Artificial Sequence
  Description of Artificial Sequence: Synthetic polynucleotide
gacatcctgatgacccagaccccactgagcctgccagtgaccccaggccagccagccagcatcagctgcaagagcagccagagcctgctgtacagcgacggcaagacctacctgaactggtacctgcagaagccaggccagagcccacagctgctgatctacctggtgagcaagctggagagcggcgtgccagaccgcttcagcggcagcggcagcggcaccgacttcaccctgaagatcagccgcgtggaggccgaggacgtgggcgtgtactactgcgtgcagggcacccacttcccatacaccttcggccagggcaccaaggtggagatcaagcgc

SEQ ID NO: 654 - protein, 116 aa, Artificial Sequence
  Description of Artificial Sequence: Synthetic polypeptide
EVQLVQSGAEVKKPGATVKISCKVSGFNIKDSLMHWVQQAPGKGLEWMGWIDPEDGETKYAPKFQDRVTITADTSTDTAYMELSSLRSEDTAVYYCVRGDWDGGYWGQGTLVTVSS

SEQ ID NO: 655 - DNA, 348 bp, Artificial Sequence
  Description of Artificial Sequence: Synthetic polynucleotide
gaggtgcagctggtgcagagcggcgccgaggtgaagaagccaggcgccaccgtgaagatcagctgcaaggtgagcggcttcaacatcaaggacagcctgatgcactgggtgcagcaggccccaggcaagggcctggagtggatgggctggatcgacccagaggacggcgagaccaagtacgccccaaagttccaggaccgcgtgaccatcaccgccgacaccagcaccgacaccgcctacatggagctgagcagcctgcgcagcgaggacaccgccgtgtactactgcgtgcgcggcgactgggacggcggctactggggccagggcaccctggtgaccgtgagcagc

SEQ ID NO: 656 - DNA, 339 bp, Artificial Sequence
  Description of Artificial Sequence: Synthetic polynucleotide
gacatcgtgatgacccagaccccactgagcctgccagtgaccccaggccagccagccagcatcagctgcaagagcagccagagcctgctgtacagcgacggcaagacctacctgaactggtacctgcagaagccaggccagagcccacagctgctgatctacctggtgagcaagctggagagcggcgtgccagaccgcttcagcggcagcggcagcggcaccgacttcaccctgaagatcagccgcgtgcaggccgaggacgtgggcgtgtactactgcgtgcagggcacccacttcccatacaccttcggccagggcaccaaggtggagatcaagcgc

SEQ ID NO: 657 - protein, 115 aa, Artificial Sequence
  Description of Artificial Sequence: Synthetic polypeptide
EVQLVQSGAEVKKPGATVKISCKVSGFNIKDSLMHWVQQAPGKGLEWMGWIDPEDGETKYAPKFQDRVTITADTSTDTAYMELSSLRSEDTAVYYCARRDWEGPWGQGTLVTVSS

SEQ ID NO: 658 - DNA, 345 bp, Artificial Sequence
  Description of Artificial Sequence: Synthetic polynucleotide
gaggtgcagctggtgcagagcggcgccgaggtgaagaagccaggcgccaccgtgaagatcagctgcaaggtgagcggcttcaacatcaaggacagcctgatgcactgggtgcagcaggccccaggcaagggcctggagtggatgggctggatcgacccagaggacggcgagaccaagtacgccccaaagttccaggaccgcgtgaccatcaccgccgacaccagcaccgacaccgcctacatggagctgagcagcctgcgcagcgaggacaccgccgtgtactactgcgcccgccgcgactgggagggcccatggggccagggcaccctggtgaccgtgagcagc

What is claimed is:

1. An isolated antibody or antigen-binding portion thereof that specifically binds to a human Tau protein, comprising the following complementarity determining regions (CDRs):
   (a) a heavy chain CDR1 having the amino acid sequence of any one of SEQ ID NOS:22, 150-154, 420-437, 586, and 587;
   (b) a heavy chain CDR2 having the amino acid sequence of any one of SEQ ID NOS:23, 438-443, and 588;
   (c) a heavy chain CDR3 having the amino acid sequence of any one of SEQ ID NOS:24 and 155;
   (d) a light chain CDR1 having the amino acid sequence of any one of SEQ ID NOS:26, 156-158, and 444-459;
   (e) a light chain CDR2 having the amino acid sequence of SEQ ID NO:27; and
   (f) a light chain CDR3 having the amino acid sequence of any one of SEQ ID NOS:28, 159-162, and 460-462.

2. The isolated antibody of claim 1, comprising:
   (a) a heavy chain CDR1 comprising the amino acid sequence of SEQ ID NO:586, a heavy chain CDR2 comprising the amino acid sequence of SEQ ID NO:439, a heavy chain CDR3 comprising the amino acid sequence of SEQ ID NO:24, a light chain CDR1 comprising the amino acid sequence of SEQ ID NO:450, a light chain CDR2 comprising the amino acid sequence of SEQ ID NO:27, and a light chain CDR3 comprising the amino acid sequence of SEQ ID NO:461; or
   (b) a heavy chain CDR1 comprising the amino acid sequence of SEQ ID NO:22, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:450, a light chain CDR2 comprising the amino acid sequence of SEQ ID NO:27, and a light chain CDR3 comprising the amino acid sequence of SEQ ID NO:461; or
   (c) a heavy chain CDR1 comprising the amino acid sequence of SEQ ID NO:22, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:459, a light chain CDR2 comprising the amino acid sequence of SEQ ID NO:27, and a light chain CDR3 comprising the amino acid sequence of SEQ ID NO:461; or
   (d) a heavy chain CDR1 comprising the amino acid sequence of SEQ ID NO:151, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:26, a light chain CDR2 comprising the amino acid sequence of SEQ ID NO:27, and a light chain CDR3 comprising the amino acid sequence of SEQ ID NO:28; or
   (e) a heavy chain CDR1 comprising the amino acid sequence of SEQ ID NO:151, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:156, a light chain CDR2 comprising the amino acid sequence of SEQ ID NO:27, and a light chain CDR3 comprising the amino acid sequence of SEQ ID NO:28; or
   (f) a heavy chain CDR1 comprising the amino acid sequence of SEQ ID NO:151, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:28; or
   (g) a heavy chain CDR1 comprising the amino acid sequence of SEQ ID NO:22, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:28; or (h) a heavy chain CDR1 comprising the amino acid sequence of SEQ ID NO:150, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:28; or (i) a heavy chain CDR1 comprising the amino acid sequence of SEQ ID NO:153, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:28; or (j) a heavy chain CDR1 comprising the amino acid sequence of SEQ ID NO:154, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:28; or (k) a heavy chain CDR1 comprising the amino acid sequence of SEQ ID NO:22, a heavy chain CDR2 comprising the amino acid sequence of SEQ ID NO:23, a heavy chain CDR3 comprising the amino acid sequence of SEQ ID NO:155, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:28; or (l) a heavy chain CDR1 comprising the amino acid sequence of SEQ ID NO:150, a heavy chain CDR2 comprising the amino acid sequence of SEQ ID NO:23, a heavy chain CDR3 comprising the amino acid sequence of SEQ ID NO:155, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:28; or (m) a heavy chain CDR1 comprising the amino acid sequence of SEQ ID NO:151, a heavy chain CDR2 comprising the amino acid sequence of SEQ ID NO:23, a heavy chain CDR3 comprising the amino acid sequence of SEQ ID NO:155, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:28; or (n) a heavy chain CDR1 comprising the amino acid sequence of SEQ ID NO:153, a heavy chain CDR2 comprising the amino acid sequence of SEQ ID NO:23, a heavy chain CDR3 comprising the amino acid sequence of SEQ ID NO:155, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:28; or (o) a heavy chain CDR1 comprising the amino acid sequence of SEQ ID NO:154, a heavy chain CDR2 comprising the amino acid sequence of SEQ ID NO:23, a heavy chain CDR3 comprising the amino acid sequence of SEQ ID NO:155, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:28; or (p) a heavy chain CDR1 comprising the amino acid sequence of SEQ ID NO:22, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:26, a light chain CDR2 comprising the amino acid sequence of SEQ ID NO:27, and a light chain CDR3 comprising the amino acid sequence of SEQ ID NO:28.

3. The isolated antibody of claim 1, comprising:

(a) a heavy chain variable region comprising an amino acid sequence that has at least 90% sequence identity to SEQ ID NO:21 and a light chain variable region comprising an amino acid sequence that has at least 90% sequence identity to SEQ ID NO:25; or (b) a heavy chain variable region comprising an amino acid sequence that has at least 90% sequence identity to SEQ ID NO:145 and a light chain variable region comprising an amino acid sequence that has at least 90% sequence identity to SEQ ID NO:149; or (c) a heavy chain variable region comprising an amino acid sequence that has at least 90% sequence identity to SEQ ID NO:146 and a light chain variable region comprising an amino acid sequence that has at least 90% sequence identity to SEQ ID NO:149; or (d) a heavy chain variable region comprising an amino acid sequence that has at least 90% sequence identity to SEQ ID NO:147 and a light chain variable region comprising an amino acid sequence that has at least 90% sequence identity to SEQ ID NO:149; or (e) a heavy chain variable region comprising an amino acid sequence that has at least 90% sequence identity to SEQ ID NO:148 and a light chain variable region comprising an amino acid sequence that has at least 90% sequence identity to SEQ ID NO:149; or (f) a heavy chain variable region comprising an amino acid sequence that has at least 90% sequence identity to SEQ ID NO:146 and a light chain variable region comprising an amino acid sequence that has at least 90% sequence identity to SEQ ID NO:463; or (g) a heavy chain variable region comprising an amino acid sequence that has at least 90% sequence identity to SEQ ID NO:146 and a light chain variable region comprising an amino acid sequence that has at least 90% sequence identity to SEQ ID NO:464.

4. The isolated antibody of claim 1, comprising:

(a) a heavy chain CDR1 comprising the amino acid sequence of SEQ ID NO:586, a heavy chain CDR2 comprising the amino acid sequence of SEQ ID NO:588, a heavy chain CDR3 comprising the amino acid sequence of SEQ ID NO:24, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:28; or
(b) a heavy chain CDR1 comprising the amino acid sequence of SEQ ID NO:586, a heavy chain CDR2 comprising the amino acid sequence of SEQ ID NO:588, a heavy chain CDR3 comprising the amino acid sequence of SEQ ID NO:24, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:461; or
(c) a heavy chain CDR1 comprising the amino acid sequence of SEQ ID NO:586, a heavy chain CDR2 comprising the amino acid sequence of SEQ ID NO:588, a heavy chain CDR3 comprising the amino acid sequence of SEQ ID NO:24, a light chain CDR1 comprising the amino acid sequence of SEQ ID NO:450, a light chain CDR2 comprising the amino acid sequence of SEQ ID NO:27, and a light chain CDR3 comprising the amino acid sequence of SEQ ID NO:461; or
(d) a heavy chain CDR1 comprising the amino acid sequence of SEQ ID NO:587, a heavy chain CDR2 comprising the amino acid sequence of SEQ ID NO:588 a heavy chain CDR3 comprising the amino acid sequence of SEQ ID NO:24, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:28; or
(e) a heavy chain CDR1 comprising the amino acid sequence of SEQ ID NO:587, a heavy chain CDR2 comprising the amino acid sequence of SEQ ID NO:588, a heavy chain CDR3 comprising the amino acid sequence of SEQ ID NO:24, a light chain CDR1 comprising the amino acid sequence of SEQ ID NO:158, a light chain CDR2 comprising the amino acid sequence of SEQ ID NO:27, and a light chain CDR3 comprising the amino acid sequence of SEQ ID NO:461; or
(f) a heavy chain CDR1 comprising the amino acid sequence of SEQ ID NO:587, a heavy chain CDR2 comprising the amino acid sequence of SEQ ID NO:588, a heavy chain CDR3 comprising the amino acid sequence of SEQ ID NO:24, a light chain CDR1 comprising the amino acid sequence of SEQ ID NO:450, a light chain CDR2 comprising the amino acid sequence of SEQ ID NO:27, and a light chain CDR3 comprising the amino acid sequence of SEQ ID NO:461.

5. The isolated antibody of claim 4, comprising:
(a) a heavy chain variable region comprising an amino acid sequence that has at least 90% sequence identity to SEQ ID NO:602 and a light chain variable region comprising an amino acid sequence that has at least 90% sequence identity to SEQ ID NO:604; or
(b) a heavy chain variable region comprising an amino acid sequence that has at least 90% sequence identity to SEQ ID NO:602 and a light chain variable region comprising an amino acid sequence that has at least 90% sequence identity to SEQ ID NO:616; or
(c) a heavy chain variable region comprising an amino acid sequence that has at least 90% sequence identity to SEQ ID NO:602 and a light chain variable region comprising an amino acid sequence that has at least 90% sequence identity to SEQ ID NO:463; or
(d) a heavy chain variable region comprising an amino acid sequence that has at least 90% sequence identity to SEQ ID NO:603 and a light chain variable region comprising an amino acid sequence that has at least 90% sequence identity to SEQ ID NO:604; or
(e) a heavy chain variable region comprising an amino acid sequence that has at least 90% sequence identity to SEQ ID NO:603 and a light chain variable region comprising an amino acid sequence that has at least 90% sequence identity to SEQ ID NO:616; or
(f) a heavy chain variable region comprising an amino acid sequence that has at least 90% sequence identity to SEQ ID NO:603 and a light chain variable region comprising an amino acid sequence that has at least 90% sequence identity to SEQ ID NO:463.

6. The isolated antibody of claim 1, wherein the antibody comprises:
(a) a first antigen-binding portion comprising a first variable region that specifically binds to the human Tau protein, wherein the first antigen-binding portion comprises (i) a first heavy chain comprising a first Fc polypeptide and (ii) a first light chain; and
(b) a second antigen-binding portion comprising a second variable region that specifically binds to the human Tau protein, wherein the second antigen-binding portion comprises (i) a second heavy chain comprising a second Fc polypeptide and (ii) a second light chain, wherein the first Fc polypeptide and the second Fc polypeptide form an Fc dimer.

7. The isolated antibody of claim 1, wherein the antibody or antigen-binding portion thereof specifically binds to the human Tau protein with a binding affinity of less than about 50 nM.

8. The isolated antibody of claim 1, wherein:
(a) the antibody or antigen-binding portion thereof specifically binds to a phosphorylated human Tau protein and/or an unphosphorylated human Tau protein; and/or
(b) the antibody or antigen-binding portion thereof specifically binds to two or more isoforms of the human Tau protein selected from the group consisting of 2N4R, 2N3R, 1N4R, 1N3R, 0N4R, and 0N3R; and/or
(c) the antibody or antigen-binding portion thereof exhibits cross-reactivity with a cynomolgus monkey Tau protein and/or a mouse Tau protein.

9. The isolated antibody of claim 1, wherein:
(a) the antibody is a monoclonal antibody; and/or
(b) the antibody is a chimeric antibody; and/or
(c) the antibody is a humanized antibody.

10. The isolated antibody of claim 1, wherein the antigen-binding portion is a Fab, a F(ab')2, a scFv, or a bivalent scFv.

11. An isolated polynucleotide comprising a nucleotide sequence encoding the isolated antibody of claim 1.

12. A method of reducing pathological Tau seeding and/or spreading in the brain of a subject and/or for treating a tauopathy in a subject, the method comprising administering to the subject the isolated antibody of claim 1.

13. The method of claim 12, wherein the tauopathy is a neurodegenerative tauopathy.

14. The method of claim 13, wherein the neurodegenerative tauopathy is selected from the group consisting of Alzheimer's disease, primary age-related tauopathy, progressive supranuclear palsy (PSP), frontotemporal dementia, frontotemporal dementia with parkinsonism linked to chromosome 17, argyrophilic grain dementia, amyotrophic lateral sclerosis/parkinsonism-dementia complex of Guam, corticobasal degeneration, chronic traumatic encephalopathy, Creutzfeldt-Jakob disease, dementia pugilistica, diffuse neurofibrillary tangles with calcification, Down's syndrome, familial British dementia, familial Danish dementia, Gerstmann-Straussler-Scheinker disease, globular glial tauopathy, Guadeloupean parkinsonism with dementia, Guadeloupean PSP, Hallevorden-Spatz disease, inclusion-body myositis, multiple system atrophy, myotonic dystrophy, neurofibrillary tangle-predominant dementia, Niemann-Pick disease type C, pallido-ponto-nigral degeneration, Parkinson's disease, Pick's disease, postencephalitic parkinsonism, prion protein cerebral amyloid angiopathy, progressive subcortical gliosis, subacute sclerosing panencephalitis, Huntington's disease, and tangle only dementia.

15. An isolated antibody or antigen-binding portion thereof that specifically binds to a human Tau protein comprising a heavy chain CDR1 comprising the amino acid sequence of SEQ ID NO:22, a heavy chain CDR2 comprising the amino acid sequence of SEQ ID NO:23, a heavy chain CDR3 comprising the amino acid sequence of SEQ ID NO:24, a light chain CDR1 comprising the amino acid sequence of SEQ ID NO:26, a light chain CDR2 comprising the amino acid sequence of SEQ ID NO:27, and a light chain CDR3 comprising the amino acid sequence of SEQ ID NO:28.

16. The isolated antibody of claim 15, comprising a heavy chain variable region comprising an amino acid sequence that has at least 90% sequence identity to SEQ ID NO:21 and a light chain variable region comprising an amino acid sequence that has at least 90% sequence identity to SEQ ID NO:25.

17. An isolated antibody or antigen-binding portion thereof that specifically binds to a human Tau protein comprising a heavy chain CDR1 comprising the amino acid sequence of SEQ ID NO:586, a heavy chain CDR2 comprising the amino acid sequence of SEQ ID NO:588, a heavy chain CDR3 comprising the amino acid sequence of SEQ ID NO:24, a light chain CDR1 comprising the amino acid sequence of SEQ ID NO:450, a light chain CDR2 comprising the amino acid sequence of SEQ ID NO:27, and a light chain CDR3 comprising the amino acid sequence of SEQ ID NO:461.

18. The isolated antibody of claim 17, comprising a heavy chain variable region comprising an amino acid sequence that has at least 90% sequence identity to SEQ ID NO:602 and a light chain variable region comprising an amino acid sequence that has at least 90% sequence identity to SEQ ID NO:463.

19. The isolated antibody of claim 16, comprising a heavy chain variable region comprising the amino acid sequence of SEQ ID NO:21 and a light chain variable region comprising the amino acid sequence of SEQ ID NO:25.

20. The isolated antibody of claim 18, comprising a heavy chain variable region comprising the amino acid sequence of SEQ ID NO:602 and a light chain variable region comprising the amino acid sequence of SEQ ID NO: 463.

21. A method of treating a tauopathy in a subject, the method comprising administering to the subject the isolated antibody of claim 15.

22. A method of treating Alzheimer's disease in a subject, the method comprising administering to the subject the isolated antibody of claim 15.

23. The method of claim 22, wherein the antibody comprises a heavy chain variable region comprising the amino acid sequence of SEQ ID NO:21 and a light chain variable region comprising the amino acid sequence of SEQ ID NO:25.

24. A method of treating a tauopathy in a subject, the method comprising administering to the subject the isolated antibody of claim 17.

25. A method of treating Alzheimer's disease in a subject, the method comprising administering to the subject the isolated antibody of claim 17.

26. The method of claim 25, wherein the antibody comprises a heavy chain variable region comprising the amino acid sequence of SEQ ID NO:602 and a light chain variable region comprising the amino acid sequence of SEQ ID NO:25.

* * * * *